US009783852B2

(12) United States Patent
Suzuki et al.

(10) Patent No.: US 9,783,852 B2
(45) Date of Patent: Oct. 10, 2017

(54) METHOD FOR ASSESSING EMBRYOTOXICITY

(75) Inventors: Noriyuki Suzuki, Nishinomiya (JP); Koichi Saito, Osaka (JP); Satoshi Ando, Toyonaka (JP); Nobuyuki Horie, Nishinomiya (JP)

(73) Assignee: SUMITOMO CHEMICAL COMPANY, LIMITED, Chuo-ku, Tokyo (JP)

( * ) Notice: Subject to any disclaimer, the term of this patent is extended or adjusted under 35 U.S.C. 154(b) by 0 days.

(21) Appl. No.: 12/995,642

(22) PCT Filed: Jun. 2, 2009

(86) PCT No.: PCT/JP2009/060410
§ 371 (c)(1),
(2), (4) Date: Feb. 10, 2011

(87) PCT Pub. No.: WO2009/148177
PCT Pub. Date: Dec. 10, 2009

(65) Prior Publication Data
US 2011/0167506 A1 Jul. 7, 2011

(30) Foreign Application Priority Data
Jun. 3, 2008 (JP) ................. 2008-145433

(51) Int. Cl.
*C12N 5/00* (2006.01)
*C12Q 1/68* (2006.01)
*C12N 5/073* (2010.01)
*G01N 33/50* (2006.01)

(52) U.S. Cl.
CPC ......... *C12Q 1/6883* (2013.01); *C12N 5/0603* (2013.01); *C12Q 1/6809* (2013.01); *G01N 33/5014* (2013.01); *A01K 2217/052* (2013.01); *A01K 2227/105* (2013.01); *A01K 2267/0393* (2013.01); *C12Q 2600/142* (2013.01)

(58) Field of Classification Search
CPC ................ C12Q 1/6883; C12Q 1/6809; G01N 33/5014; C12N 5/0603
See application file for complete search history.

(56) References Cited

U.S. PATENT DOCUMENTS

| 2003/0162177 A1 | 8/2003 | Shu et al. |
| 2008/0311567 A1 | 12/2008 | Bruckl et al. |
| 2010/0248229 A1* | 9/2010 | Deb et al. ................ 435/6 |

FOREIGN PATENT DOCUMENTS

| JP | 2003514550 | 4/2003 |
| JP | 2005536186 | 12/2005 |
| WO | WO 00/34525 A1 | 6/2000 |
| WO | 0136482 | 5/2001 |
| WO | 03080640 | 10/2003 |
| WO | 2005005662 | 1/2005 |
| WO | 2006015742 | 2/2006 |
| WO | 2008021288 | 2/2008 |
| WO | 2008021290 | 2/2008 |

OTHER PUBLICATIONS

Huber et al. Science 300:1251-1256, 2003.*
Niu et al. J, Neurosci 28(41):10339-10348, 2008.*
Pacholsky et al. J Cell Sci 117(22):5257-5268, 2004.*
Knofler et al. Gene 224:77-86, 1998.*
EF208956 (Hand1 complete sequence. Printout from http://www.ncbi.nlm.nih.gov/nuccore/EF208956.1, pp. 1-3, printed May 22, 2015; publicly available in 2007).*
Spielmann et al., "The Embryonic Stem Cell Test, an In Vitro Embryotoxicity Test Using Two Permanent Mouse Cell Lines: 3T3 Fibroblasts and Embryonic Stem Cells", In Vitro Toxicology 10: 119-127 (1997).
Genschow et al., "Validation of the Embryonic Stem Cell Test in the International ECVAM Validation Study on Three In Vitro Embryotoxicity Tests". ATLA, 32:209-244 (2004).
Genschow et al., "The ECVAM International Validation Study on In Vitro Embryotoxicity Tests: Results of the Definitive Phase and Evaluation of Prediction Models", ATLA, 30:151-176 (2002).
Vasicek et al., "Expression of the Human Hand1 Gene in Trophoblastic Cells is Transcriptionally Regulated by Activating and Repressing Specificity Protein (Sp)-elements", Gene, 302:115-127 (2003).
Hollenberg et al., "Identification of a New Family of Tissue-Specific Basic Helix-Loop-Helix Proteins with a Two-Hybrid System", Mol. Cell. Biol. 15:3813-3822 (1995).
Cserjesi et al., "Expression of the Novel Basic Helix-Loop-Helix Gene eHAND in Neural Crest Derivatives and Extraembryonic Membranes during Mouse Development", Dev.Biol., 170:664-678 (1995).
Kosazuma et al., "Organ Culture of the Fetal Mouse Palato for Screening the Developmental Toxicity of Chemicals: A Validation Study". Congenit.Anom., 44:60-71 (2004).
Laschinski et al., "Cytotoxicity Test Using Blastocyst-Derived Euploid Embryonal Stem Cells: A New Approach to In Vitro Teratogenesis Screening". Reprod. Toxicology. 5:57-64 (1991).
Seiler et al., "Improvement of an In Vitro Stem Cell Assay for Development Toxicity: the Use of Molecular Endpoints in the Embryonic Stem Cell Test". Reprod. Toxicology. 18:231-240 (2004).

(Continued)

*Primary Examiner* — Marcia S Noble
(74) *Attorney, Agent, or Firm* — Sughrue Mion, PLLC

(57) ABSTRACT

The present invention provides a method for assessing embryotoxicity of a chemical comprising: (1) a first step of measuring the expression level of one or more genes selected from among genes each comprising any of the nucleotide sequences of SEQ ID NOs: 1 to 78 and 101 to 230 and orthologous genes thereof in a sample from a non-human mammal or mammalian cell which has come into contact with a test chemical; and (2) a second step of comparing the measured value of the expression level of the gene in the sample obtained in the first step with a control value of the expression level of the gene and based on the difference assessing the level of the embryotoxicity of the test chemical in the sample; and so on.

17 Claims, 28 Drawing Sheets

(56) References Cited

OTHER PUBLICATIONS

Nemeth et al., "Searching for Biomarkers of Developmental Toxicity with Microarrays: Normal Eye Morphogenesis in Rodent Embryos". Toxicol. Appl. Pharmacol. 205: 219-226 (2005).
Adler et al., "First Steps in Establishing a Developmental Toxicity Test Method Based on Human Embryonic Stem Cells". Toxicol. In Vitro, 22:200-211 (2008).
McFadden et al., "The Hand1 and Hand2 Transcription Factors Regulate Expansion of the Embryonic Cardiac Ventricles in a Gene Dosage-Dependent Manner", Development, 132:189-201 (2005).
Rininger et al., "Differential Gene Expression Technologies for Identifying Surrogate Markers of Drug Efficacy and Toxicity", Drug Discovery Today, 5(12):560-568 (2000).
Patent Examination Report No. 1 for Australian Application No. 2009255027 dated Dec. 15, 2014.
Notice of Reasons for Rejection for Japanese Application No. 2013-250834 dated Feb. 2, 2015.
Notice of Reasons for Rejection for Japanese Application No. 2013-250835 dated Feb. 2, 2015.

* cited by examiner

METHOD FOR ASSESSING EMBRYOTOXICITY

CROSS REFERENCE TO RELATED APPLICATIONS

This application is a National Stage of International Application No. PCT/JP2009/060410, filed on Jun. 2, 2009, which claims priority from Japanese Patent Application No. 2008-145433 filed on Jun. 3, 2008, the contents of all of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Jan. 21, 2011, is named Q121950.txt and is 911,874 bytes in size.

TECHNICAL FIELD

The present invention relates to a method for assessing embryotoxicity of chemicals, and so on.

BACKGROUND ART

In order to assess safety in human of such chemicals as pharmaceuticals, pesticides, cosmetics and industrial products, many toxicity tests using non-human animals are typically conducted. Toxicities to reproductive ability and to development of unborn child and newborn are included in toxicity collectively referred to as reproductive and developmental toxicity, and it is required to conduct tests for these toxicities for production and distribution of pharmaceuticals, pesticides and other chemicals. As an example of developmental toxicity test, referred to as a teratogenicity test is a test in which a chemical is administered to a non-human mammal during its pregnancy followed by examining the fetus of the mammal for presence and extent of morphological defect, and in general, developmental toxicity of a chemical is evaluated by administering the chemical for a certain period to a pregnant female of a non-human animal such as rat, mouse, rabbit or simian and closely observing the external form, internal organs and skeleton of the fetus of the animal.

However, the developmental toxicity test using non-human animals requires a lot of time and cost, such as those for breeding of animals. Therefore, developed as simplified methods for embryotoxicity testing using mammalian cells or tissue have been a testing method using mouse embryonic stem cells (hereinafter, sometimes referred to as ES cells) (EST: Embryonic Stem cell Test) (H. Spielmann, I. Pohl, B. Doring, M. Liebsch, F. Moldenhauer, In vitro toxicology, 10(1), p 119-127, 1997, E. Genschow, H. Spielmann, G. Scholz, I. Pohl, A. Seiler, N. Clemann, S. Bremer, K. Becker, ATLA 32, p 209-244, 2004), micromass culture using rat embryo limb buds and whole-embryo culture using an early rat embryo (E. Genschow, H. Spielmann, G. Scholz, A. Seiler, N. Brown, A. Piersma, M. Brady, N. Clemann, H. Huuskonen, F. Paillard, S. Bremer, K. Becker, ATLA 30, p 151-176, 2002), and so on, however, reliability on accuracy has not been established in any method.

DISCLOSURE OF THE INVENTION

The object of the present invention is to provide a simple and versatile testing method for embryotoxicity of chemicals.

The present invention provides:
[Invention 1]
a method for assessing embryotoxicity of a chemical comprising:
(1) a first step of measuring the expression level of one or more genes selected from among genes each comprising any of the nucleotide sequences of SEQ ID NOs: 1 to 78 and 101 to 230 and orthologous genes thereof in a sample from a non-human mammal or mammalian cell which has come into contact with a test chemical; and
(2) a second step of comparing the measured value of the expression level of the gene in the sample obtained in the first step with a control value of the expression level of the gene and based on the difference assessing the level of the embryotoxicity of the test chemical in the sample;
[Invention 2]
the method according to Invention 1, wherein the sample is a stem cell, an embryonic stem cell, a cardiac tissue cell, a brain tissue cell, a neural tissue cell, a muscle tissue cell, a skeletal tissue cell, a pregnant non-human animal or a non-human unborn child;
[Invention 3]
the method according to Invention 1 or 2, wherein measuring the expression level of the gene is conducted by measuring the amount of transcription product or the amount of translation product;
[Invention 4]
the method according to anyone of Inventions 1 to 3, wherein the control value of the expression level of the gene is a measured value for the expression level of the gene in a sample from a non-human mammal or mammalian cell which has not come into contact with the test chemical;
[Invention 5]
a method for screening a chemical having embryotoxicity comprising a step of selecting a chemical having a specified level of embryotoxicity based on the level of the embryotoxicity of a chemical assessed by the method of any one of Inventions 1 to 4;
[Invention 6]
a method for obtaining a marker gene for assessing embryotoxicity of a chemical comprising:
(1) a step A of measuring the expression level of a gene comprising any of the nucleotide sequences of SEQ ID NOs: 1 to 78 and 101 to 230 in a specific tissue cell that has come into contact with a test chemical during differentiation of a stem cell into the tissue cell;
(2) a step B of comparing the measured value of the expression level of the gene in the step A with a control value of the expression level of the gene and based on the difference, identifying another gene which shows alteration in the expression level specific to a contact with the test chemical; and
(3) a step C of obtaining the gene identified in the step B;
[Invention 7]
a method for obtaining a marker gene for assessing embryotoxicity of a chemical comprising:
(1) a step A of measuring alteration during differentiation in the expression of a gene that comprises any of the nucleotide sequences of SEQ ID NOs: 1 to 78 and 101 to 230 during differentiation of a stem cell into a specific tissue cell and identifying a gene with altered expression;
(2) a step B of measuring the expression level of the gene identified in the step A in the tissue cell which has come into contact with a test chemical; and
(3) a step C of comparing the measured value of the expression level of the gene in the step B with a control value of the expression level of the gene and based on the difference, identifying and obtaining another gene that shows alteration specific to the test chemical;

[Invention 8]

a method for using one or more genes selected from among genes each comprising any of the nucleotide sequences of SEQ ID NOs: 1 to 78 and 101 to 230 and orthologous genes thereof as a marker gene for assessing embryotoxicity of a chemical in the method of Invention 1;

[Invention 9]

the method according to anyone of Inventions 1 to 8, wherein the gene is Hand1 gene, ADAM19 gene, Cmya1 gene, Pitx2 gene, Smyd1 gene, Pim2 gene, Tbx20 gene, Myl4 gene, Myl7 gene, Hbb-bh1 gene, Hba-a1 gene, Col1a2 gene, Hba-x gene, Basp1 gene, Cpe gene, DDR1 gene, Marcks gene, NDN gene, Nnat gene, Ptbp2 gene, Sfrp gene, Sox11 gene, Ttc3 gene, Tubb2b gene, Ubqln2 gene, Vim gene, Six3 gene, Arx gene, Dcx gene, L1cam gene, Emx2 gene, Wnt1 gene, Reln gene, or Pax6 gene;

[Invention 10]

the method according to Invention 1 to 5, wherein the expression level of the gene is measured using as an indicator the expression level of a reporter gene that comprises a promoter sequence of the gene and a reporter protein coding sequence operably linked to the promoter sequence;

[Invention 11]

a nucleic acid construct comprising a reporter gene that comprises a promoter sequence of the gene defined in Invention 9 and a reporter protein coding sequence operably linked to the promoter sequence;

[Invention 12]

a vector comprising the nucleic acid construct of Invention 11;

[Invention 13]

a transformant in which the nucleic acid construct of Invention 11 or the vector of Invention 12 has been introduced into a host cell;

[Invention 14]

the transformant according to Invention 13, wherein the host cell is an animal cell;

[Invention 15]

the transformant according to Invention 13, wherein the host cell is a stem cell;

[Invention 16]

the transformant according to Invention 13, wherein the host cell is an embryonic stem cell;

[Invention 17]

a method for producing a transformant comprising introducing the nucleic acid construct of Invention 11 or the vector of Invention 12 into a host cell;

[Invention 18]

use of the transformant of Inventions 13 to 16 for the method for assessing embryotoxicity of a chemical;

[Invention 19]

a genetically-modified non-human animal in which the nucleic acid construct of Invention 11 or the vector of Invention 12 has been introduced; and

[Invention 20]

use of the genetically-modified non-human animal of Invention 19 for the method for assessing embryotoxicity of a chemical;

and so on.

MODE FOR CARRYING OUT THE INVENTION

Figure 1:
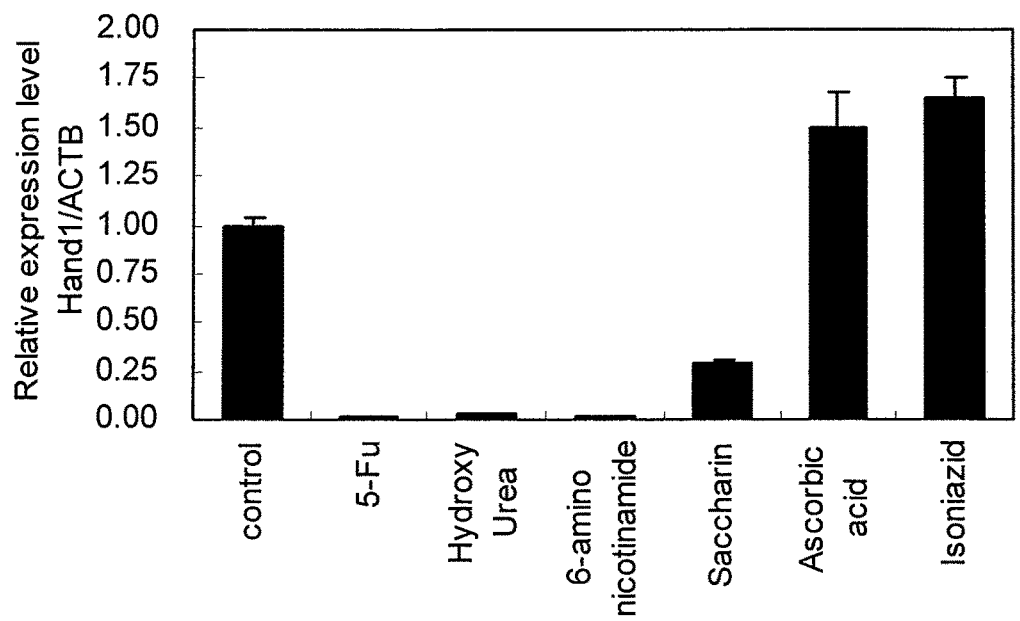
FIGS. 1 to 13 are drawings showing expression levels of marker genes for assessing embryotoxicity as relative expression levels, the expression levels being quantitated by using real-time PCR method for a solvent control group, groups treated with embryotoxic chemicals (5-fluorouracil, hydroxyurea and 6-aminonicotinamide) and groups treated with non-embryotoxic chemicals (saccharin sodium hydrate, ascorbic acid and isoniazid).

The method for assessing embryotoxicity of a chemical according to the present invention comprises:

(1) a first step of measuring the expression level of one or more genes selected from among genes each comprising any of the nucleotide sequences shown below and orthologous genes thereof in a sample from a non-human mammal or mammalian cell which has come into contact with a test chemical; and (2) a second step of comparing the measured value of the expression level of the gene in the sample obtained in the first step with a control value of the expression level of the gene and based on the difference assessing the level of the embryotoxicity of the test chemical in the sample:

(1) the nucleotide sequence of SEQ ID NO: 1,
(2) the nucleotide sequence of SEQ ID NO: 2,
(3) the nucleotide sequence of SEQ ID NO: 3,
(4) the nucleotide sequence of SEQ ID NO: 4,
(5) the nucleotide sequence of SEQ ID NO: 5,
(6) the nucleotide sequence of SEQ ID NO: 6,
(7) the nucleotide sequence of SEQ ID NO: 7,
(8) the nucleotide sequence of SEQ ID NO: 8,
(9) the nucleotide sequence of SEQ ID NO: 9,
(10) the nucleotide sequence of SEQ ID NO: 10,
(11) the nucleotide sequence of SEQ ID NO: 11,
(12) the nucleotide sequence of SEQ ID NO: 12,
(13) the nucleotide sequence of SEQ ID NO: 13,
(14) the nucleotide sequence of SEQ ID NO: 14,
(15) the nucleotide sequence of SEQ ID NO: 15,
(16) the nucleotide sequence of SEQ ID NO: 16,
(17) the nucleotide sequence of SEQ ID NO: 17,
(18) the nucleotide sequence of SEQ ID NO: 18,
(19) the nucleotide sequence of SEQ ID NO: 19,
(20) the nucleotide sequence of SEQ ID NO: 20,
(21) the nucleotide sequence of SEQ ID NO: 21,
(22) the nucleotide sequence of SEQ ID NO: 22,
(23) the nucleotide sequence of SEQ ID NO: 23,
(24) the nucleotide sequence of SEQ ID NO: 24,
(25) the nucleotide sequence of SEQ ID NO: 25,
(26) the nucleotide sequence of SEQ ID NO: 26,
(27) the nucleotide sequence of SEQ ID NO: 27,
(28) the nucleotide sequence of SEQ ID NO: 28,
(29) the nucleotide sequence of SEQ ID NO: 29,
(30) the nucleotide sequence of SEQ ID NO: 30,
(31) the nucleotide sequence of SEQ ID NO: 31,
(32) the nucleotide sequence of SEQ ID NO: 32,
(33) the nucleotide sequence of SEQ ID NO: 33,
(34) the nucleotide sequence of SEQ ID NO: 34,
(35) the nucleotide sequence of SEQ ID NO: 35,
(36) the nucleotide sequence of SEQ ID NO: 36,
(37) the nucleotide sequence of SEQ ID NO: 37,
(38) the nucleotide sequence of SEQ ID NO: 38,
(39) the nucleotide sequence of SEQ ID NO: 39,
(40) the nucleotide sequence of SEQ ID NO: 40,
(41) the nucleotide sequence of SEQ ID NO: 41,
(42) the nucleotide sequence of SEQ ID NO: 42,
(43) the nucleotide sequence of SEQ ID NO: 43,
(44) the nucleotide sequence of SEQ ID NO: 44,
(45) the nucleotide sequence of SEQ ID NO: 45,
(46) the nucleotide sequence of SEQ ID NO: 46,
(47) the nucleotide sequence of SEQ ID NO: 47,
(48) the nucleotide sequence of SEQ ID NO: 48,
(49) the nucleotide sequence of SEQ ID NO: 49,
(50) the nucleotide sequence of SEQ ID NO: 50,
(51) the nucleotide sequence of SEQ ID NO: 51,
(52) the nucleotide sequence of SEQ ID NO: 52,
(53) the nucleotide sequence of SEQ ID NO: 53,
(54) the nucleotide sequence of SEQ ID NO: 54,
(55) the nucleotide sequence of SEQ ID NO: 55,
(56) the nucleotide sequence of SEQ ID NO: 56,
(57) the nucleotide sequence of SEQ ID NO: 57,
(58) the nucleotide sequence of SEQ ID NO: 58,
(58) the nucleotide sequence of SEQ ID NO: 59,
(60) the nucleotide sequence of SEQ ID NO: 60,
(61) the nucleotide sequence of SEQ ID NO: 61,
(62) the nucleotide sequence of SEQ ID NO: 62,
(63) the nucleotide sequence of SEQ ID NO: 63,
(64) the nucleotide sequence of SEQ ID NO: 64,
(65) the nucleotide sequence of SEQ ID NO: 65,
(66) the nucleotide sequence of SEQ ID NO: 66,
(67) the nucleotide sequence of SEQ ID NO: 67,
(68) the nucleotide sequence of SEQ ID NO: 68,
(69) the nucleotide sequence of SEQ ID NO: 69,
(70) the nucleotide sequence of SEQ ID NO: 70,
(71) the nucleotide sequence of SEQ ID NO: 71,
(72) the nucleotide sequence of SEQ ID NO: 72,
(73) the nucleotide sequence of SEQ ID NO: 73,
(74) the nucleotide sequence of SEQ ID NO: 74,
(75) the nucleotide sequence of SEQ ID NO: 75,
(76) the nucleotide sequence of SEQ ID NO: 76,
(77) the nucleotide sequence of SEQ ID NO: 77,
(78) the nucleotide sequence of SEQ ID NO: 78,
(101) the nucleotide sequence of SEQ ID NO: 101,
(102) the nucleotide sequence of SEQ ID NO: 102,
(103) the nucleotide sequence of SEQ ID NO: 103,
(104) the nucleotide sequence of SEQ ID NO: 104,
(105) the nucleotide sequence of SEQ ID NO: 105,
(106) the nucleotide sequence of SEQ ID NO: 106,
(107) the nucleotide sequence of SEQ ID NO: 107,
(108) the nucleotide sequence of SEQ ID NO: 108,
(109) the nucleotide sequence of SEQ ID NO: 109,
(110) the nucleotide sequence of SEQ ID NO: 110,
(111) the nucleotide sequence of SEQ ID NO: 111,
(112) the nucleotide sequence of SEQ ID NO: 112,
(113) the nucleotide sequence of SEQ ID NO: 113,
(114) the nucleotide sequence of SEQ ID NO: 114,
(115) the nucleotide sequence of SEQ ID NO: 115,
(116) the nucleotide sequence of SEQ ID NO: 116,
(117) the nucleotide sequence of SEQ ID NO: 117,
(118) the nucleotide sequence of SEQ ID NO: 118,
(119) the nucleotide sequence of SEQ ID NO: 119,
(120) the nucleotide sequence of SEQ ID NO: 120,
(121) the nucleotide sequence of SEQ ID NO: 121,
(122) the nucleotide sequence of SEQ ID NO: 122,
(123) the nucleotide sequence of SEQ ID NO: 123,
(124) the nucleotide sequence of SEQ ID NO: 124,
(125) the nucleotide sequence of SEQ ID NO: 125,
(126) the nucleotide sequence of SEQ ID NO: 126,
(127) the nucleotide sequence of SEQ ID NO: 127,
(128) the nucleotide sequence of SEQ ID NO: 128,
(129) the nucleotide sequence of SEQ ID NO: 129,
(130) the nucleotide sequence of SEQ ID NO: 130,
(131) the nucleotide sequence of SEQ ID NO: 131,
(132) the nucleotide sequence of SEQ ID NO: 132,
(133) the nucleotide sequence of SEQ ID NO: 133,
(134) the nucleotide sequence of SEQ ID NO: 134,
(135) the nucleotide sequence of SEQ ID NO: 135,
(136) the nucleotide sequence of SEQ ID NO: 136,
(137) the nucleotide sequence of SEQ ID NO: 137,
(138) the nucleotide sequence of SEQ ID NO: 138,
(139) the nucleotide sequence of SEQ ID NO: 139,
(140) the nucleotide sequence of SEQ ID NO: 140,
(141) the nucleotide sequence of SEQ ID NO: 141, (142) the nucleotide sequence of SEQ ID NO: 142,
(143) the nucleotide sequence of SEQ ID NO: 143,
(144) the nucleotide sequence of SEQ ID NO: 144,
(145) the nucleotide sequence of SEQ ID NO: 145,
(146) the nucleotide sequence of SEQ ID NO: 146,
(147) the nucleotide sequence of SEQ ID NO: 147,
(148) the nucleotide sequence of SEQ ID NO: 148,
(149) the nucleotide sequence of SEQ ID NO: 149,
(150) the nucleotide sequence of SEQ ID NO: 150,
(151) the nucleotide sequence of SEQ ID NO: 151,
(152) the nucleotide sequence of SEQ ID NO: 152,
(153) the nucleotide sequence of SEQ ID NO: 153,
(154) the nucleotide sequence of SEQ ID NO: 154,
(155) the nucleotide sequence of SEQ ID NO: 155,
(156) the nucleotide sequence of SEQ ID NO: 156,
(157) the nucleotide sequence of SEQ ID NO: 157,
(158) the nucleotide sequence of SEQ ID NO: 158,
(159) the nucleotide sequence of SEQ ID NO: 159,
(160) the nucleotide sequence of SEQ ID NO: 160,
(161) the nucleotide sequence of SEQ ID NO: 161,
(162) the nucleotide sequence of SEQ ID NO: 162,
(163) the nucleotide sequence of SEQ ID NO: 163,
(164) the nucleotide sequence of SEQ ID NO: 164,
(165) the nucleotide sequence of SEQ ID NO: 165,
(166) the nucleotide sequence of SEQ ID NO: 166,
(167) the nucleotide sequence of SEQ ID NO: 167,
(168) the nucleotide sequence of SEQ ID NO: 168,
(169) the nucleotide sequence of SEQ ID NO: 169,
(170) the nucleotide sequence of SEQ ID NO: 170,
(171) the nucleotide sequence of SEQ ID NO: 171,
(172) the nucleotide sequence of SEQ ID NO: 172,
(173) the nucleotide sequence of SEQ ID NO: 173,
(174) the nucleotide sequence of SEQ ID NO: 174,
(175) the nucleotide sequence of SEQ ID NO: 175,
(176) the nucleotide sequence of SEQ ID NO: 176,
(177) the nucleotide sequence of SEQ ID NO: 177,
(178) the nucleotide sequence of SEQ ID NO: 178,
(179) the nucleotide sequence of SEQ ID NO: 179,
(180) the nucleotide sequence of SEQ ID NO: 180,
(181) the nucleotide sequence of SEQ ID NO: 181,
(182) the nucleotide sequence of SEQ ID NO: 182,
(183) the nucleotide sequence of SEQ ID NO: 183,
(184) the nucleotide sequence of SEQ ID NO: 184,
(185) the nucleotide sequence of SEQ ID NO: 185,
(186) the nucleotide sequence of SEQ ID NO: 186,
(187) the nucleotide sequence of SEQ ID NO: 187,
(188) the nucleotide sequence of SEQ ID NO: 188,
(189) the nucleotide sequence of SEQ ID NO: 189,
(190) the nucleotide sequence of SEQ ID NO: 190,
(191) the nucleotide sequence of SEQ ID NO: 191,
(192) the nucleotide sequence of SEQ ID NO: 192,
(193) the nucleotide sequence of SEQ ID NO: 193,
(194) the nucleotide sequence of SEQ ID NO: 194,
(195) the nucleotide sequence of SEQ ID NO: 195,
(196) the nucleotide sequence of SEQ ID NO: 196,
(197) the nucleotide sequence of SEQ ID NO: 197,
(198) the nucleotide sequence of SEQ ID NO: 198,
(199) the nucleotide sequence of SEQ ID NO: 199,
(200) the nucleotide sequence of SEQ ID NO: 200,
(201) the nucleotide sequence of SEQ ID NO: 201,
(202) the nucleotide sequence of SEQ ID NO: 202,
(203) the nucleotide sequence of SEQ ID NO: 203,
(204) the nucleotide sequence of SEQ ID NO: 204,
(205) the nucleotide sequence of SEQ ID NO: 205,
(206) the nucleotide sequence of SEQ ID NO: 206,
(207) the nucleotide sequence of SEQ ID NO: 207,
(208) the nucleotide sequence of SEQ ID NO: 208,
(209) the nucleotide sequence of SEQ ID NO: 209,
(210) the nucleotide sequence of SEQ ID NO: 210,
(211) the nucleotide sequence of SEQ ID NO: 211,
(212) the nucleotide sequence of SEQ ID NO: 212,
(213) the nucleotide sequence of SEQ ID NO: 213,
(214) the nucleotide sequence of SEQ ID NO: 214,
(215) the nucleotide sequence of SEQ ID NO: 215,
(216) the nucleotide sequence of SEQ ID NO: 216,
(217) the nucleotide sequence of SEQ ID NO: 217,
(218) the nucleotide sequence of SEQ ID NO: 218,
(219) the nucleotide sequence of SEQ ID NO: 219,
(220) the nucleotide sequence of SEQ ID NO: 220,
(221) the nucleotide sequence of SEQ ID NO: 221,
(222) the nucleotide sequence of SEQ ID NO: 222,
(223) the nucleotide sequence of SEQ ID NO: 223,
(224) the nucleotide sequence of SEQ ID NO: 224,
(225) the nucleotide sequence of SEQ ID NO: 225,
(226) the nucleotide sequence of SEQ ID NO: 226,
(227) the nucleotide sequence of SEQ ID NO: 227,
(228) the nucleotide sequence of SEQ ID NO: 228,
(229) the nucleotide sequence of SEQ ID NO: 229, and
(230) the nucleotide sequence of SEQ ID NO: 230.

As used herein, "chemical" refers to a chemical for which the presence or absence of embryotoxicity has been reported with data of animal test and epidemiological data on human, and a chemical for which embryotoxicity is unknown. Specifically, known as the chemical for which embryotoxicity is known are 5-fluorouracil, hydroxyurea, 6-aminonicotinamide, 5-bromo-2'-deoxyuridine, methotrexate, all-trans-retinoic acid, phenytonin, varpoic acid, phenobarbital Na, thalidomide, ribavirin, cyclophosphamide, leflunomide, warfarin, sulfadimetcin, 6-mercaptopurine, aspirin, acetazolamide, cyclizine HCl, estrogene, testosterone, lead acetate, arsenic, retinol, toluene, aminopterine, azathiopurine, captafol, methadone, acutane, and so on, and those are described in NTP abstract published by U.S. NTP (National Toxicology Program). These descriptions are incorporated in the present invention by reference.

As used herein, "embryotoxicity" is a collective term of harmful effects causing adverse effects and abnormalities on fertilization and the development (generation) of unborn child relating to conception, and also includes teratogenicity or teratogeny causing malformation to a fetus. The adverse effects and abnormalities caused by developmental toxicity specifically includes, but are not limited to, congenital anomalies showing macroscopic morphological or functional abnormalities such as growth retardation or impairment of function or intelligence, and fetal death during fetal life.

As used herein, "non-human mammal" includes a mammal species used in toxicological tests, pharmacological tests, and so on. For example, mammals such as rat, mouse, simian, canine, rabbit, hamster and guinea pig are known, but are not limited thereto.

As used herein, examples of "mammalian cell" include a cell of mammals such as human, rat, mouse, simian, canine, rabbit, hamster and guinea pig.

As used herein, "sample" includes a stem cell, an embryonic stem cell, a cardiac tissue cell, a brain tissue cell, a neural tissue cell, a muscle tissue cell, a skeletal tissue cell, a pregnant non-human animal and a non-human unborn child.

As used herein, "stem cell" refers to a cell that retains the same differentiation capacity even going through cell division, and when a tissue is damaged, the cell can regenerate the tissue. Stem cells used herein may be, but are not limited to, embryonic stem cells or tissue stem cells (also called tissular stem cells, tissue-specific stem cells, or somatic stem cells) or induced pluripotent stem cell cells (iPS cells).

As used herein, "embryonic stem cell (ES cell)" refers to a stem cell capable of self replication and having multipotency (i.e. "pluripotency") and refers to pluripotent stem cells derived from early embryos. An embryonic stem cell was first established in 1981, which has also been applied to production of knockout mice since 1989. In 1998, a human embryonic stem cell was established, which is becoming also available for regenerative medicine. Unlike embryonic stem cells, tissue stem cells have a limited differentiation direction, are present at particular locations in tissues and have an undifferentiated intracellular structure. Therefore, tissue stem cells have a low level of pluripotency. Tissue stem cells have a high nucleus/cytoplasm ratio and have few intracellular organelles. Tissue stem cells generally have multipotency and a late cell cycle, and retain proliferative ability beyond the life of the individual. An induced pluripotent stem cell is a cell obtained by directly initializing differentiated cells such as fibroblasts by the expression of several types of genes such as Oct3/4, sox2, klf4, and myc to induce multipotency and has been established by Yamanaka, et al. with mouse cells in 2006 (Takahashi K, Yamanaka S. Cell. 2006, 126(4), p 663-676). In 2007, induced pluripotent stem cells have been established also for human fibroblasts and have multipotency as well as embryonic stem cells (Takahashi K, Tanabe K, Ohnuki M, Narita M, Ichisaka T, Tomoda K, Yamanaka S. Cell. 2007, 131(5), p 861-872. Yu J, Vodyanik M A, Smuga-Otto K, Antosiewicz-Bourget J, Frane J L, Tian S, Nie J, Jonsdottir G A, Ruotti V, Stewart R, Slukvin I I, Thomson J A., Science. 2007, 318 (5858), p 1917-1920. Nakagawa M, Koyanagi M, Tanabe K, Takahashi K, Ichisaka T, Aoi T, Okita K, Mochiduki Y, Takizawa N, Yamanaka S. Nat Biotechnol., 2008, 26(1), p 101-106). As used herein, stem cells may be preferably embryonic stem cells, and tissue stem cells or induced pluripotent stem cells may be also employed, depending on the circumstance.

As used herein, "gene" refers to an element defining a genetic trait. A gene is typically arranged in a given sequence on a chromosome. A region which the primary structure of a protein is called a structural gene, and a region which regulates the expression of a structural gene is called a regulatory gene (e.g., "promoter"). As used herein, "gene" may refer to "polynucleotide," "oligonucleotide," or "nucleic acid." As used herein, the terms "polynucleotide," "oligonucleotide," and "nucleic acid" are used interchangeably to refer to a polymer of nucleotides of any length.

As used herein, "expression of a gene" includes expressions of polynucleotide, oligonucleotide, and nucleic acid and/or protein, polypeptide, oligopeptide and peptide, which are expressed depending on a gene. As used herein, the terms "protein," "polypeptide," "oligopeptide," and "peptide" are used interchangeably to refer to a polymer of amino acids of any length. This polymer may be a straight, branched or cyclic chain. An amino acid may be a naturally-occurring or non naturally-occurring amino acid, or an altered amino acid.

As used herein, examples of the method for "measuring the expression level of a gene" include, in a cell and the like of interest, a method for measuring the amount of transcription product or amount of translated product of a gene and the like. Examples of the method for measuring the amount of transcription product of a gene include a method for measuring the expression level of mRNA, any appropriate methods including molecular biological measurement methods, specifically, such as Northern blotting method, dot blotting method, PCR method, and real-time PCR method. The method for measuring the amount of translated product of a gene includes a method for measuring the expression level of polypeptide encoded by the gene, any appropriate methods including immunological measurement methods, specifically, such as ELISA method, RIA method, fluorescent antibody method, Western blotting method, and immunohistological staining method. Also, expression variation of a gene means that the expression level in mRNA level or polypeptide level evaluated by any appropriate method including typical molecular biological measurement methods or immunological measurement methods increases or decreases.

The expression level of a gene can be also measured using as an indicator the expression level of a reporter gene containing a promoter sequence of the gene and a reporter protein coding sequence operably linked to the promoter sequence.

Examples of the molecular biological measurement method include Northern blotting method, dot blotting method, PCR method, and the like. Examples of the immunological measurement method include, as a method, ELISA method, RIA method, fluorescent antibody method, Western blotting method, immunohistological staining method, and the like. Furthermore, a method for detecting immunohistological staining may be also carried out by the analysis method using flow cytometry or FACS (fluorescence activated cell sorting) exemplified in the literature (A. Seiler, A. Visan, R. Buesen, E. Genschow, H. Spielmann, Reproductive Toxicology 18, p 231-240 (2004)). In addition, measurement may be also carried out by gene analysis methods using arrays (e.g., a DNA array, a protein array). The DNA array is widely reviewed in Saibo-Kogaku [Cell Engineering], special issue, "DNA Microarray and Up-to-date PCR Method," edited by Shujun-sha. The protein array is described in detail in Nat. Genet. 2002 December; 32 Suppl: 526-32. In addition to the above-described techniques, the measurement methods include, but are not limited to, RT-PCR, RACE method, SSCP method, immunoprecipitation method, two-hybrid system, in vitro translation, and the like. Other analysis methods are described in, for example, Genome Analysis Experimental Method, Yusuke Nakamura's Lab-Manual, edited by Yusuke Nakamura, Yodo-sha (2002), and the like. All of the above-described publications are herein incorporated by reference.

In the first step of the assessing method of the present invention, measured according to the above-described techniques is the expression level of one or more genes selected from among genes each comprising any of the nucleotide sequences of SEQ ID NOs: 1 to 78 and 101 to 230 and orthologous genes thereof (hereinafter, sometimes collectively referred to as the present gene) in a sample derived from a non-human mammal or mammalian cell which has come into contact with the chemical.

The nucleotide sequences of SEQ ID NOs: 1 to 78 and 101 to 230 are the nucleotide sequence of Hand1 gene, ADAM19 gene, Cmya1 gene, Pitx2 gene, Smyd1 gene, Pim2 gene, Tbx20 gene, Myl4 gene, Myl7 gene, Hbb-bh1 gene, Hba-a1 gene, Col1a2 gene, Hba-x gene, Basp1 gene, Cpe gene, DDR1 gene, Marcks gene, NDN gene, Nnat gene, Ptbp2 gene, Sfrp gene, Sox11 gene, Ttc3 gene, Tubb2b gene, Ubqln2 gene, Vim gene, Six3 gene, Arx gene, Dcx gene, L1cam gene, Emx2 gene, Wnt1 gene, Reln gene, or Pax6 gene, and are the sequences of the genes of various animal species such as mouse, human, simian, rat, and canine. The nucleotide sequences of SEQ ID NOs: 1 to 78 and 101 to 230 are the nucleotide sequences registered in NCBI (National Center for Biotechnology Information), and these are available from NCBI Web page (URL; http://www.ncbi.nlm.nih.gov) by searching a database based on gene name or partial sequence.

The nucleotide sequences of SEQ ID NOs: 1 to 5 are the nucleotide sequences encoding each of the full-length mRNA of hand1 genes of mouse, human, chimpanzee, canine, and rat.

The nucleotide sequences of SEQ ID NOs: 6 to 14 are the nucleotide sequences encoding each of the full-length mRNA of ADAM19 genes of mouse, human isoform 1 and isoform 2, 4 types of chimpanzee, canine, and rat.

The nucleotide sequences of SEQ ID NOs: 15 to 18 are the nucleotide sequences encoding each of the full-length mRNA of Cmya1 genes of mouse, human, canine, and rat.

The nucleotide sequences of SEQ ID NOs: 19 to 35 are the nucleotide sequences encoding each of the full-length mRNA of Pitx2 genes of mouse isoforms c, a, and b; human isoforms c, b, and a; 6 types of chimpanzee; 3 types of canine; and rat isoforms 1 and 2.

The nucleotide sequences of SEQ ID NOs: 36 to 40 are the nucleotide sequences encoding each of the full-length mRNA of Smyd1 genes of mouse, human, 2 types of canine, and rat.

The nucleotide sequences of SEQ ID NOs: 41 to 44 are the nucleotide sequences encoding each of the full-length mRNA of Pim2 genes of mouse, human, chimpanzee, and canine.

The nucleotide sequences of SEQ ID NOs: 45 to 50 are the nucleotide sequences encoding each of the full-length mRNA of Tbx20 genes of mouse isoforms b and a, chimpanzee, and 3 types of canine.

The nucleotide sequences of SEQ ID NOs: 51 to 56 are the nucleotide sequences encoding each of the full-length mRNA of Myl4 genes of mouse, 2 types of human, chimpanzee, and 2 types of canine.

The nucleotide sequences of SEQ ID NOs: 57 to 60 are the nucleotide sequences encoding each of the full-length mRNA of Myl7 genes of mouse, human, chimpanzee, and rat.

The nucleotide sequences of SEQ ID NOs: 61 to 65 are the nucleotide sequences encoding each of the full-length mRNA of Hbb-bh1 genes of mouse, human, chimpanzee, canine, and rat.

The nucleotide sequences of SEQ ID NOs: 66 to 70 encode Hba-a1 gene set forth below and are the nucleotide sequences encoding each of the full-length mRNA of Hba-a1 genes of mouse; human isoforms α2 and α1; and rat isoforms α1 and α2.

The nucleotide sequences of SEQ ID NOs: 71 to 75 are the nucleotide sequences encoding each of the full-length mRNA of Col1a2 genes of mouse, human, chimpanzee, canine, and rat.

The nucleotide sequences of SEQ ID NOs: 76 to 78 are the nucleotide sequences encoding each of the full-length mRNA of Hba-x genes of mouse, human, and chimpanzee.

The nucleotide sequences of SEQ ID NOs: 101 to 106 are the nucleotide sequences encoding each of the full-length mRNA of basp1 genes of human, chimpanzee, canine, bovine, mouse, and rat.

The nucleotide sequences of SEQ ID NOs: 107 to 110 are the nucleotide sequences encoding each of the full-length mRNA of Cpe genes of human, chimpanzee, canine, and mouse.

The nucleotide sequences of SEQ ID NOs: 111 to 119 are the nucleotide sequences encoding each of the full-length mRNA of Ddr1 genes of human isoform b, isoform a, and isoform c; chimpanzee; canine; bovine; mouse isoform 1 and isoform 2; and rat.

The nucleotide sequences of SEQ ID NOs: 120 to 125 are the nucleotide sequences encoding each of the full-length mRNA of Marcks genes of human, chimpanzee, canine, bovine, mouse, and rat.

The nucleotide sequences of SEQ ID NOs: 126 to 131 are the nucleotide sequences encoding each of the full-length mRNA of Ndn genes of human, chimpanzee, canine, bovine, mouse, and rat.

The nucleotide sequences of SEQ ID NOs: 132 to 139 are the nucleotide sequences encoding each of the full-length mRNA of Nnat genes of human isoform a and isoform b; chimpanzee; canine; mouse isoform a and isoform b; and rat isoform a and isoform b.

The nucleotide sequences of SEQ ID NOs: 140 to 145 are the nucleotide sequences encoding each of the full-length mRNA of Ptbp2 genes of human, chimpanzee, canine, bovine, mouse, and rat.

The nucleotide sequences of SEQ ID NOs: 146 to 151 are the nucleotide sequences encoding each of the full-length mRNA of Sfrp2 genes of human, chimpanzee, canine, bovine, mouse, and rat.

The nucleotide sequences of SEQ ID NOs: 152 to 155 are the nucleotide sequences encoding each of the full-length mRNA of Sox11 genes of human, bovine, mouse, and rat.

The nucleotide sequences of SEQ ID NOs: 156 to 162 are the nucleotide sequences encoding each of the full-length mRNA of Ttc3 genes of 2 types of human, chimpanzee, canine, bovine, mouse, and rat.

The nucleotide sequences of SEQ ID NOs: 163 to 167 are the nucleotide sequences encoding each of the full-length mRNA of Tubb2b genes of mouse, human, chimpanzee, canine, and rat.

The nucleotide sequences of SEQ ID NOs: 168 to 173 are the nucleotide sequences encoding each of the full-length mRNA of Ubqln2 genes of mouse, human, chimpanzee, canine, bovine, and rat.

The nucleotide sequences of SEQ ID NOs: 174 to 179 are the nucleotide sequences encoding each of the full-length mRNA of Vim genes of human, chimpanzee, canine, bovine, mouse, and rat.

The nucleotide sequences of SEQ ID NOs: 180 to 184 are the nucleotide sequences encoding each of the full-length mRNA of Six3 genes of human, chimpanzee, bovine, mouse, and rat.

The nucleotide sequences of SEQ ID NOs: 185 to 188 are the nucleotide sequences encoding each of the full-length mRNA of Arx genes of human, canine, mouse, and rat.

The nucleotide sequences of SEQ ID NOs: 189 to 199 are the nucleotide sequences encoding each of the full-length mRNA of Dcx genes of human isoform a, isoform c, isoform b and isoform c, chimpanzee, canine, 2 types of mouse isoforms a, mouse isoform b and isoform c, and rat.

The nucleotide sequences of SEQ ID NOs: 200 to 206 are the nucleotide sequences encoding each of the full-length mRNA of L1cam genes of human isoform 1 and isoform 2, chimpanzee, canine, bovine, mouse, and rat.

The nucleotide sequences of SEQ ID NOs: 207 to 212 are the nucleotide sequences encoding each of the full-length mRNA of Emx2 genes of human, chimpanzee, canine, bovine, mouse, and rat.

The nucleotide sequences of SEQ ID NOs: 213 to 218 are the nucleotide sequences encoding each of the full-length mRNA of Wnt1 genes of human, chimpanzee, canine, bovine, mouse, and rat.

The nucleotide sequences of SEQ ID NOs: 219 to 225 are the nucleotide sequences encoding each of the full-length mRNA of Reln genes of human isoform a and isoform b, chimpanzee, canine, bovine, mouse, and rat.

The nucleotide sequences of SEQ ID NOs: 226 to 230 are the nucleotide sequences encoding each of the full-length mRNA of Pax6 genes of mouse, 2 types of human isoforms a and human isoform b, and rat.

The orthologs of a gene that comprises any of the nucleotide sequences of SEQ ID NOs: 1 to 78 and 101 to 230 include a gene having a nucleotide sequence in which deletion, substitution or addition of a nucleotide has occurred in the nucleotide sequence by a naturally occurring mutation due to a difference in organism species, a difference between individuals, or a difference between organs or tissues, or the like.

In the second step of the assessing method of the present invention, the measured value of the expression level of the present gene in the sample obtained in the first step is compared with a control value of the expression level of the present gene, and based on the difference, the level of the embryotoxicity of the test chemical in the sample is assessed.

Examples of "control value of the expression level of a gene" include a measured value for the expression level of the present gene in a sample derived from a non-human mammal or mammalian cell which has not come into contact with a test chemical. The control value may be obtained in parallel with the expression level of the gene in a sample derived from a non-human mammal or mammalian cell which has come into contact with a test chemical, or may be separately obtained. For example, using a measured value for the expression level of the present gene in a sample derived from a non-human mammal or mammalian cell which has not come into contact with a test chemical as a control value, when a measured value for the expression level of the present gene in a sample derived from a non-human mammal or mammalian cell which has come into contact with a test chemical is significantly different from the control value, the chemical can be assessed to have embryotoxicity.

Specifically, for example, in a case where a test chemical has embryotoxicity, using a measured value for the expression level of the genes having the nucleotide sequences of SEQ ID NOs: 1 to 78 or orthologous genes thereof in myocardiac cells derived from ES cells which have not come into contact with the chemical as a control value, at or below the concentration that does not show inhibition of cell proliferation, when a measured value for the expression level of the genes having the nucleotide sequences of SEQ ID NOs: 1 to 78 or orthologous genes thereof in myocardiac cells derived from ES cells which have come into contact with the chemical is lower than the control value, the chemical can be assessed to have embryotoxicity. Alternatively, as an index of the effects of a test chemical on a mother animal, the 50% inhibitory concentration for cell growth ($IC_{50}$) is measured using differentiated cells such as balb/c 3T3, and as an index of the effects of the test chemical on an unborn child, the 50% inhibitory concentration for differentiation ($ID_{50}$) is obtained from the measured value of the expression level of the genes having the nucleotide sequences of SEQ ID NOs: 1 to 78 or orthologous genes thereof during myocardial differentiation of ES cells which has come into contact with the chemical and ES cells which have not come into contact with the chemical. When the chemical has $ID_{50} < IC_{50}$, the chemical is considered to have stronger effect on an unborn child as compared to on a mother animal and is assessed to have embryotoxicity.

Also, for example, in a case where a test chemical has embryotoxicity, using a measured value for the expression level of the genes having the nucleotide sequences of SEQ ID NOs: 101 to 230 or orthologous genes thereof in neural cells derived from ES cells which have not come into contact with the chemical as a control value, at or below the concentration that does not show inhibition of cell proliferation, when a measured value for the expression level of the genes having the nucleotide sequences of SEQ ID NOs: 101 to 230 or orthologous genes thereof in neural cells derived from ES cells which have come into contact with the chemical is lower than the control value, the chemical can be assessed to have embryotoxicity. Alternatively, as an index of the effects of a test chemical on a mother animal, the 50% inhibitory concentration for cell growth ($IC_{50}$) is measured using differentiated cells such as balb/c 3T3, and as an index of the effects of the test chemical on an unborn child, the 50% inhibitory concentration for differentiation ($ID_{50}$) is obtained from the measured value of the expression level of the genes having the nucleotide sequences of SEQ ID NOs: 101 to 230 or orthologous genes thereof during neural differentiation of ES cells which has come into contact with the chemical and ES cells which have not come into contact with the chemical. When the chemical has $ID_{50} < IC_{50}$, the chemical is considered to have stronger effect on an unborn child as compared to on a mother animal and is assessed to have embryotoxicity.

Based on the level of the embryotoxicity of the chemical assessed according to the method of the present invention, a chemical having a specific level of embryotoxicity can be selected, and a chemical having embryotoxicity can be screened. Specifically, for example, using a measured value for the expression level of the genes having the nucleotide sequences of SEQ ID NOs: 1 to 78 or orthologous genes thereof in myocardiac cells derived from ES cells which have not come into contact with a specific chemical as a control value, at or below the concentration that does not show inhibition of cell proliferation, when a measured value for the expression level of the genes having the nucleotide sequences of SEQ ID NOs: 1 to 78 or orthologous genes thereof in myocardiac cells derived from ES cells which have come into contact with the specific chemical is lower than the control value, it is revealed that the specific chemical is a chemical having embryotoxicity. Alternatively, as an index of the effects of a test chemical on a mother animal, the 50% inhibitory concentration for cell growth ($IC_{50}$) is measured using differentiated cells such as balb/c 3T3, and as an index of the effects of the test chemical on an unborn child, the 50% inhibitory concentration for differentiation ($ID_{50}$) is obtained from the measured value of the expression level of the genes having the nucleotide sequences of SEQ ID NOs: 1 to 78 or orthologous genes thereof during myocardial differentiation of ES cells which has come into contact with the chemical and ES cells which have not come into contact with the chemical. When the chemical has $ID_{50} < IC_{50}$, the chemical is considered to have stronger effect on an unborn child as compared to on a mother animal and it is revealed that the chemical has embryotoxicity.

Also, for example, using a measured value for the expression level of the genes having the nucleotide sequences of SEQ ID NOs: 101 to 230 or orthologous genes thereof in neural cells derived from ES cells which have not come into contact with a specific chemical as a control value, at or below the concentration that does not show inhibition of cell proliferation, when a measured value for the expression level of the genes having the nucleotide sequences of SEQ ID NOs: 101 to 230 or orthologous genes thereof in neural cells derived from ES cells which have come into contact with the specific chemical is lower than the control value, it is revealed that the specific chemical is a chemical having embryotoxicity. Alternatively, as an index of the effects of a test chemical on a mother animal, the 50% inhibitory concentration for cell growth ($IC_{50}$) is measured using differentiated cells such as balb/c 3T3, and as an index of the effects of the test chemical on an unborn child, the 50% inhibitory concentration for differentiation ($ID_{50}$) is obtained from the measured value of the expression level of the genes having the nucleotide sequences of SEQ ID NOs: 101 to 230 or orthologous genes thereof during neural differentiation of ES cells which has come into contact with the chemical and ES cells which have not come into contact with the chemical. When the chemical has $ID_{50} < IC_{50}$, the chemical is considered to have stronger effect on an unborn child as compared to on a mother animal and it is revealed that the chemical has embryotoxicity.

It is possible to use one or more genes selected from among genes each comprising any of the nucleotide sequences of SEQ ID NOs: 1 to 78 and 101 to 230 or orthologous genes thereof as a marker gene for assessing embryotoxicity of a chemical.

As used herein, "cardiac tissue cell" refers to a tissue cell that forms the heart and is a tissue or cell including cardiomyocyte, valve, vessel, ventricle and atrium. A cardiac tissue cell functionally refers to a tissue cell functioning as a pump for circulating blood by rhythmical contractions. The structure of the heart comprises a ventricle that pumps blood out of the heart by contraction, an atrium located upstream of the ventricle that accumulates blood before entering the ventricle and pumps blood to the ventricle, vessels, and valve that prevents backflow of blood. Cardiac muscle comprises cardiomyocytes that involuntarily produce rhythmical contractions and can be also differentiation-induced from stem cells. Examples of a method for identifying a differentiated cardiac muscle can include a method of confirmation with the expression of cardiac muscle myosin light chain Myh6 gene, atrial natriuretic peptide ANP gene, or the like.

As used herein, "brain and neural tissue" refers to nervous system tissue cells including the central nervous system that collectively lies in the midline of the body for the integration of information and the peripheral nervous system that lies outside of the central and is individually recognized as a fiber. The nervous system tissue cells consist of nerve cells (alias: neuron) and neuroglia cells (alias: glial cells). The basic functions of nerve cells are to generate an action potential and transmit information to other cells, when an input stimulus enters a nerve cell. The information is modified by inputting from plural cells to one nerve cell or changing the threshold to generate an action potential. Also, neuroglia cells (astrocytes and oligodendrocytes) are a cell group involved in the maintenance of the nervous system. Nerve cells and glial cells can be also differentiation-induced from stem cells. Examples of a method for identifying a differentiated nerve can include a method of confirmation with the expression of a gene specifically expressing neural cells such as MAP2 gene, GFAP gene, and the like.

As used herein, "muscular and skeletal tissue" contains muscles comprising/forming skeletons such as striated muscles, smooth muscles, and tendons and cells comprising/forming bones such as osteoblasts, osteoclasts, and chondrocytes. Muscular and skeletal tissue can be also differentiation-induced from stem cells. A method for identifying cells of a differentiated muscular and skeletal tissue can include a method of confirmation with the gene expression such as RunX2 gene and osteoproteogerin gene for osteoblasts and MyoD gene and the like for muscles.

As used herein, "differentiation" refers to the phenomenon where two or more types of cells having qualitative differences in form and/or function occur in a daughter cell population derived from the division of a single cell. Therefore, differentiation also includes the process where population of cells (family tree of cells) derived from cells whose specific feature cannot be originally detected acquire a distinct feature, such as the production of a specific protein, or the like. At present, cell differentiation is generally considered to be the state of a cell in which a specific group of genes in the genome are expressed, and cell differentiation can be identified by searching for intracellular or extracellular agents or conditions which elicit the above-described state of gene expression. Differentiated cells are stable in principle, and particularly in animal cells, differentiation into other types of cells happens only exceptionally.

As used herein, "specific tissue cell" refers to a cell having a specialized function and form, and has no or little pluripotency unlike stem cells. Examples of specific tissue cells include epidermal cells, pancreatic parenchymal cells, pancreatic duct cells, hepatic cells, blood cells, cardiomyocytes, skeletal myocytes, osteoblasts, skeletal myoblasts, neural cells, vascular endothelial cells, pigment cells, smooth myocytes, fat cells, bone cells, chondrocytes, and the like.

"Hand1" gene refers to "heart and neural crest derivatives expressed transcript 1" gene and is sometimes also described as Hxt, Th1, eHAND, Ehand1, and Thing1, other than Hand1. In the database of the National center for Biotechnology Information (NCBI), for example, the nucleotide sequence encoding mRNA of mouse Hand1 gene appears under accession number NM_008213.2, and the amino acid sequence encoded by the nucleotide sequence appears under accession number NP_032239.1. The nucleotide sequence encoding mRNA of human Hand1 gene appears under accession number NM_004821.1, and the amino acid sequence encoded by the nucleotide sequence appears under accession number NP_004812.1. The nucleotide sequence encoding mRNA of chimpanzee Hand1 gene appears under accession number XM_518050.2, and the amino acid sequence encoded by the nucleotide sequence appears under accession number XP_518050.2. The nucleotide sequence encoding mRNA of canine Hand1 gene appears under accession number XM_546282.2, and the amino acid sequence encoded by the nucleotide sequence appears under accession number XP_546282.2. The nucleotide sequence encoding mRNA of rat Hand1 gene appears under accession number NM_021592.2, and the amino acid sequence encoded by the nucleotide sequence appears under accession number XP_067603.1. The nucleotide sequences of Hand1 genes described above are shown in SEQ ID NOs: 1 to 5 of the present application.

"ADAM19" gene refers to "a disintegrin and metallopeptidase domain 19" gene or "meltrin beta" gene and is sometimes also described as M[b], Mltnb, and AL024287. In the database of NCBI, for example, the nucleotide sequence encoding mRNA of mouse ADAM19 gene appears under accession number NM_009616.3, and the amino acid sequence encoded by the nucleotide sequence appears under accession number NP_033746.1. The nucleotide sequence encoding mRNA of isoform 1 of human ADAM19 gene appears under accession number NM_023038.3, the amino acid sequence encoded by the nucleotide sequence appears under accession number NP_075525.2, the nucleotide sequence encoding mRNA of isoform 2 appears under accession number NM_033274.2, and the amino acid sequence encoded by the nucleotide sequence appears under accession number NP_150377.1. The nucleotide sequences encoding mRNA of chimpanzee ADAM19 gene appear under accession numbers XM_001137770.1, XM_001137856.1, XM_001137686.1, and XM_001137600.1, and the amino acid sequences encoded by the nucleotide sequences appear under accession numbers XP_001137770.1, XP_001137856.1, XP_001137686.1, and XP_001137600.1, respectively. The nucleotide sequence encoding mRNA of canine ADAM19 gene appears under accession number XM_546274.2, and the amino acid sequence encoded by the nucleotide sequence appears under accession number XP_546274.2. The nucleotide sequence encoding mRNA of rat ADAM19 gene appears under accession number XM_001069002.1, and the amino acid sequence encoded by the nucleotide sequence appears under accession number XP_001069002.1. The nucleotide sequences of ADAM19 genes described above are shown in SEQ ID NOs: 6 to 14 of the present application. In addition, orthologous genes of the above-described genes also appear in the database of NCBI, and for example, the nucleotide sequence encoding mRNA of chicken ADAM19 gene appears under accession number XM_414565.2, and the amino acid sequence encoded by the nucleotide sequence appears under accession number XP_414565.2. The nucleotide sequence encoding mRNA of zebrafish ADAM19 gene appears under accession number XM_688620.2, and the amino acid sequence encoded by the nucleotide sequence appears under accession number XP_693712.2.

"Cmya1" gene refers to "xin actin-binding repeat containing 1" gene and is sometimes also described as Xirp1, Xin, mXin, AI415219, MGC144145, and MGC144146. In the database of NCBI, for example, the nucleotide sequence encoding mRNA of mouse cmya1 gene appears under accession number NM_001081339.1, and the amino acid sequence encoded by the nucleotide sequence appears under accession number NP_001074808.1. The nucleotide sequence encoding mRNA of human cmya1 gene appears under accession number NM_194293.2, and the amino acid sequence encoded by the nucleotide sequence appears under accession number NP_919269.2. The nucleotide sequence encoding mRNA of canine cmya1 gene appears under accession number XM_846492.1, and the amino acid sequence encoded by the nucleotide sequence appears under accession number XP_851585.1. The nucleotide sequence encoding mRNA of rat cmya1 gene appears under accession number XM_236702.4 or XM_001077697.1, and the amino acid sequence encoded by the nucleotide sequence appears under accession number XP_236702.4 or XP_001077697.1, respectively. The nucleotide sequences of cmya1 genes described above are shown in SEQ ID NOs: 15 to 18 of the present application.

"Pitx2" gene refers to "paired-like homeodomain transcription factor 2" gene and is sometimes also described as Brx1, Ptx2, Rieg, Brx1a, Brx1b, Otlx2, Munc30, Pitx2a, Pitx2b, Pitx2c, solurshin, and 9430085M16Rik. In the database of NCBI, for example, the nucleotide sequence encoding mRNA of isoform c of mouse pitx2 gene appears under accession number NM_001042502.1, the amino acid sequence encoded by the nucleotide sequence appears under accession number NP_001035967.1, the nucleotide sequence encoding mRNA of isoform a appears under accession number NM_001042504.1, the amino acid sequence encoded by the nucleotide sequence appears under accession number NP_001035969.1, the nucleotide sequence encoding mRNA of isoform b appears under accession number NM_011098.3, and the amino acid sequence encoded by the nucleotide sequence appears under accession number NP_035228.2. The nucleotide sequence encoding mRNA of isoform a of human pitx2 gene appears under accession number NM_153427.1, the amino acid sequence encoded by the nucleotide sequence appears under accession number NP_700476.1, the nucleotide sequence encoding mRNA of isoform b appears under accession number NM_153426.1, the amino acid sequence encoded by the nucleotide sequence appears under accession number NP_700475.1, the nucleotide sequence encoding mRNA of isoform c appears under accession number NM_000325.5, and the amino acid sequence encoded by the nucleotide sequence appears under accession number NP_000316.2. The nucleotide sequences encoding mRNA of chimpanzee pitx2 gene appear under accession numbers XM_001141151.1, XM_517398.2, XM_001141078.1, XM_001141403.1, XM_001141320.1, and XM_001141234.1, and the amino acid sequences encoded by the nucleotide sequences appear under accession numbers XP_001141151.1, XP_517398.2, XP_001141078.1, XP_001141403.1, XP_001141320.1, and XP_001141234.1, respectively. The nucleotide sequences encoding mRNA of canine pitx2 gene appear under accession numbers XM_858568.1, XM_545025.2, and XM_846277.1, and the amino acid sequences encoded by the nucleotide sequences appear under accession numbers XP_863661.1, XP_545025.2, and XP_851370.1, respectively. The nucleotide sequence encoding mRNA of isoform 1 of rat pitx2 gene appears under accession number NM_001042505.1, the amino acid sequence encoded by the nucleotide sequence appears under accession number NP_001035970.1, the nucleotide sequence encoding mRNA of isoform 2 appears under accession number NM_019334.2, and the amino acid sequence encoded by the nucleotide sequence appears under accession number NP_062207.1. The nucleotide sequences of pitx2 genes described above are shown in SEQ ID NOs: 19 to 35 of the present application. In addition, orthologous genes of the above-described genes also appear in the database of NCBI, and for example, the nucleotide sequence encoding mRNA of chicken pitx2 gene appears under accession number NM_205010.1, and the amino acid sequence encoded by the nucleotide sequence appears under accession number NP_990341.1. The nucleotide sequence encoding mRNA of zebrafish pitx2 gene appears under accession number NM_130975.1, and the amino acid sequence encoded by the nucleotide sequence appears under accession number NP_571050.1. The nucleotide sequence encoding mRNA of isoform a of *drosophila* pitx2 gene appears under accession number NM_170531.3, the amino acid sequence encoded by the nucleotide sequence appears under accession number NP_733410.2, the nucleotide sequence encoding mRNA of isoform b appears under accession number NM_176593.1, the amino acid sequence encoded by the nucleotide sequence appears under accession number NP_788770.1, the nucleotide sequence encoding mRNA of isoform c appears under accession number NM_206591.1, and the amino acid sequence encoded by the nucleotide sequence appears under accession number NP_996314.1. The nucleotide sequence encoding mRNA of nematode pitx2 gene appears under accession number NM_001042502.1 or NM_001026106.1, and the amino acid sequence encoded by the nucleotide sequence appears under accession number NP_001021276.1 or NP_001021277.1, respectively.

"Smyd1" gene refers to "SET and MYND domain containing 1" gene as a formal name and is sometimes also described as Bop, C78565, Zmynd18, and 4632404M21Rik. In the database of NCBI, for example, the nucleotide sequence encoding mRNA of mouse smyd1 gene appears under accession number NM_009762.1, and the amino acid sequence encoded by the nucleotide sequence appears under accession number NP_033892.1. The nucleotide sequence encoding mRNA of human smyd1 gene appears under accession number NM_198274.2, and the amino acid sequence encoded by the nucleotide sequence appears under accession number NP_938015.1. The nucleotide sequences encoding mRNA of canine smyd1 gene appear under accession numbers XM_532967.2 and XM_847011.1, and the amino acid sequences encoded by the nucleotide sequences appear under accession numbers XP_532967.1 and XP_852104.1, respectively. The nucleotide sequence encoding mRNA of rat smyd1 gene appears under accession number NM_001106595.1, and the amino acid sequence encoded by the nucleotide sequence appears under accession number NP_001100065.1. The nucleotide sequences of smyd1 genes described above are shown in SEQ ID NOs: 36 to 40 of the present application. In addition, orthologous genes of the above-described genes also appear in the database of NCBI, and for example, the nucleotide sequences encoding mRNA of rat smyd1 gene appear under accession numbers XM_216172.4 and XM_001062526.1, and the amino acid sequences encoded by the nucleotide sequences appear under accession numbers XP_216172.4 and XP_001062526.1, respectively. The nucleotide sequence encoding mRNA of chicken smyd1 gene appears under accession number NM_204155.1, and the amino acid sequence encoded by the nucleotide sequence appears under accession number NP_989486.1. The nucleotide sequence encoding mRNA of zebrafish smyd1 gene appears under accession number NM_001039636.1, and the amino acid sequence encoded by the nucleotide sequence appears under accession number NP_001034725.1.

"Pim2" gene refers to "proviral integration site 2" gene and is sometimes also described as Pim-2 and DXCch3. In the database of NCBI, for example, the nucleotide sequence encoding mRNA of mouse pim2 gene appears under accession number NM_138606.2, and the amino acid sequence encoded by the nucleotide sequence appears under accession number NP_613072.1. The nucleotide sequence encoding mRNA of human pim2 gene appears under accession number NM_006875.2, and the amino acid sequence encoded by the nucleotide sequence appears under accession number NP_006866.2. The nucleotide sequence encoding mRNA of chimpanzee pim2 gene appears under accession number XM_528972.2, and the amino acid sequence encoded by the nucleotide sequence appears under accession number XP_528972.2. The nucleotide sequence encoding mRNA of canine pim2 gene appears under accession number XM_548990.2, and the amino acid sequence encoded by the nucleotide sequence appears under accession number XP_548990.2. The nucleotide sequences of pim2 genes described above are shown in SEQ ID NOs: 41 to 44 of the present application. In addition, orthologous genes of the above-described genes also appear in the database of NCBI, and for example, the nucleotide sequence encoding mRNA of zebrafish pim2 gene appears under accession number NM_131539.1, and the amino acid sequence encoded by the nucleotide sequence appears under accession number NP_571614.1.

"Tbx20" gene refers to "T-box 20" gene and is sometimes also described as Tbx12, AL022859, and 9430010M06Rik. In the database of NCBI, for example, the nucleotide sequence encoding mRNA of mouse tbx20 gene isoform a appears under accession number NM_194263.1, the amino acid sequence encoded by the nucleotide sequence appears under accession number NP_919239.1, the nucleotide sequence encoding mRNA of mouse tbx20 gene isoform b appears under accession number NM_020496.2, and the amino acid sequence encoded by the nucleotide sequence appears under accession number NP_065242.1. The nucleotide sequence encoding mRNA of chimpanzee tbx20 gene appears under accession number XM_522453.2, and the amino acid sequence encoded by the nucleotide sequences appears under accession number XP_522453.2. The nucleotide sequences encoding mRNA of canine tbx20 gene appear under accession numbers XM_539513.2, XM_860427.1 and XM_860408.1, and the amino acid sequences encoded by the nucleotide sequences appear under accession numbers XP_539513.2, XP_865520.1 and XP_865501.1, respectively. The nucleotide sequences of tbx20 genes described above are shown in SEQ ID NOs: 45 to 50 of the present application. In addition, orthologous genes of the above-described genes also appear in the database of NCBI, and for example, the nucleotide sequence encoding mRNA of chicken tbx20 gene appears under accession number NM_204144.1, and the amino acid sequence encoded by the nucleotide sequence appears under accession number NP_989475.1. The nucleotide sequence encoding mRNA of zebrafish tbx20 gene appears under accession number NM_131506.1, and the amino acid sequence encoded by the nucleotide sequence appears under accession number NP_571581.1. Also, the nucleotide sequence encoding mRNA of *drosophila* tbx20 gene appears under accession number NM_135083.2, and the amino acid sequence encoded by the nucleotide sequence appears under accession number NP_608927.2. The nucleotide sequence encoding mRNA of nematode tbx20 gene appears under accession number NM_061349.4, and the amino acid sequence encoded by the nucleotide sequence appears under accession number NP_493750.1.

"Myl4" gene refers to "myosin, light polypeptide 4" gene and is sometimes also described as ELC, GT1, ALC1, AMLC, Myla, ELC1a, and MLC1a. In the database of NCBI, for example, the nucleotide sequence encoding mRNA of mouse Myl4 gene appears under accession number NM_010858.4, and the amino acid sequence encoded by the nucleotide sequence appears under accession number NP_034988.2. The nucleotide sequences encoding mRNA of human myl4 gene appear under accession numbers NM_001002841.1 and NM_002476.2, and the amino acid sequences encoded by the nucleotide sequences appear under accession numbers NP_001002841.1 and NP_002467.1, respectively. The nucleotide sequence encoding mRNA of chimpanzee myl4 gene appears under accession number XM_511623.2, and the amino acid sequence encoded by the nucleotide sequence appears under accession number XP_511623.1. The nucleotide sequences encoding mRNA of canine myl4 gene appear under accession numbers XM_537609.2 and XM_854741.1, and the amino acid sequences encoded by the nucleotide sequences appear under accession numbers XP_537609.1 and XP_859834.1, respectively. The nucleotide sequences of myl4 genes described above are shown in SEQ ID NOs: 51 to 56 of the present application. In addition, orthologous genes of the above-described genes also appear in the database of NCBI, and for example, the nucleotide sequence encoding mRNA of chicken myl4 gene appears under accession number NM_205479.1, and the amino acid sequence encoded by the nucleotide sequence appears under accession number NP_990810.1. The nucleotide sequence encoding mRNA of zebrafish myl4 gene appears under accession number NM_131692.1, and the amino acid sequence encoded by the nucleotide sequence appears under accession number NP_571767.1.

"Myl7" gene refers to "myosin, light polypeptide 7, regulatory" gene and is sometimes also described as MLC2a, MYL2A, RLC-A, Mylc2a, and MLC-2alpha. In the database of NCBI, for example, the nucleotide sequence encoding mRNA of mouse myl7 gene appears under accession number NM_022879.2, and the amino acid sequence encoded by the nucleotide sequence appears under accession number NP_075017.2. The nucleotide sequence encoding mRNA of human myl7 gene appears under accession number NM_021223.2, and the amino acid sequence encoded by the nucleotide sequence appears under accession number NP_067046.1. The nucleotide sequence encoding mRNA of chimpanzee myl7 gene appears under accession number XM_519549.2, and the amino acid sequence encoded by the nucleotide sequence appears under accession number XP_519549.2. The nucleotide sequence encoding mRNA of rat myl7 gene appears under accession number NM_001106017.1, and the amino acid sequence encoded by the nucleotide sequence appears under accession number NP_001099487.1. The nucleotide sequences of myl7 genes described above are shown in SEQ ID NOs: 57 to 60 of the present application. In addition, orthologous genes of the above-described genes also appear in the database of NCBI, and for example, the nucleotide sequence encoding mRNA of rat myl7 gene appear under accession numbers XM_214074.4 and XM_001069249.1, and the amino acid sequences encoded by the nucleotide sequences appear under accession numbers XP_214074.4 and XP_001069249.1, respectively. The nucleotide sequence encoding mRNA of zebrafish myl7 gene appears under accession number NM_131329.2, and the amino acid sequence encoded by the nucleotide sequence appears under accession number NP_571404.1.

"Hbb-bh1" gene refers to "hemoglobin Z, beta-like embryonic chain" gene and is sometimes also described as betaH1. In the database of NCBI, for example, the nucleotide sequence encoding mRNA of mouse Hbb-bh1 gene appears under accession number NM_008219.3 and the amino acid sequence accession number NP_032245.1. The nucleotide sequence encoding mRNA of human Hbb-bh1 gene appears under accession number NM_000559.2, and the amino acid sequence encoded by the nucleotide sequence appears under accession number NP_000550.2. The nucleotide sequence encoding mRNA of chimpanzee Hbb-bh1 gene appears under accession number XM_001161821.1, and the amino acid sequence encoded by the nucleotide sequence appears under accession number XP_001161821.1. The nucleotide sequence encoding mRNA of canine Hbb-bh1 gene appears under accession number XM_542373.2, and the amino acid sequence encoded by the nucleotide sequence appears under accession number XP_542373.2. The nucleotide sequence encoding mRNA of rat Hbb-bh1 gene appears under accession number NM_172093.1, and the amino acid sequence encoded by the nucleotide sequence appears under accession number NP_742090.1. The nucleotide sequences of Hbb-bh1 genes described above are shown in SEQ ID NOs: 61 to 65 of the present application. In addition, orthologous genes of the above-described genes also appear in the database of NCBI, and for example, the nucleotide sequences encoding mRNA of chimpanzee Hbb-bh1 gene appear under accession numbers NM_001071779.1, XM_001161863.1, XM_001161978.1, XM_001161706.1, XM_001162021.1, XM_001161903.1, XM_001161943.1, XM_001161662.1, XM_001162055.1, XM_508243.2, and XM_001161615.1, and the amino acid sequences encoded by the nucleotide sequences appear under accession numbers NP_001065247.1, XP_001161863.1, XP_001161978.1, XP_001161706.1, XP_001162021.1, XP_001161903.1, XP_001161943.1, XP_001161662.1, XP_001162055.1, XP_508243.1, and XP_001161615.1, respectively. The nucleotide sequence encoding mRNA of chicken Hbb-bh1 gene appears under accession number NM_001031489.1, and the amino acid sequence encoded by the nucleotide sequence appears under accession number NP_001026660.1. The nucleotide sequence encoding mRNA of zebrafish Hbb-bh1 gene appears under accession number NM_001015058.1, and the amino acid sequence encoded by the nucleotide sequence appears under accession number NP_001015058.1.

"Hba-a1" gene refers to "hemoglobin alpha, adult chain 1" gene and is sometimes also described as Hba1. In the database of NCBI, for example, the nucleotide sequence encoding mRNA of mouse Hba-a1 gene appears under accession number NM_008218.2, and the amino acid sequence encoded by the nucleotide sequence appears under accession number NP_032244.2. The nucleotide sequence encoding mRNA of isoform α1 of human Hba-a1 gene appears under accession number NM_000558.3, the amino acid sequence encoded by the nucleotide sequence appears under accession number NP_000549.1, the nucleotide sequence encoding mRNA of isoform α2 appears under accession number NM_000517.3, and the amino acid sequence encoded by the nucleotide sequence appears under accession number NP_000508.1. The nucleotide sequence encoding mRNA of isoform α1 of rat Hba-a1 gene appears under accession number NM_013096.1, the amino acid sequence encoded by the nucleotide sequence appears under accession number NP_037228.1, the nucleotide sequence encoding mRNA of isoform α2 appears under accession number NM_001007722.1, and the amino acid sequence encoded by the nucleotide sequence appears under accession number NP_001007723.1. The nucleotide sequences of Hba-a1 genes described above are shown in SEQ ID NOs: 66 to 70 of the present application. In addition, orthologous genes of the above-described genes also appear in the database of NCBI, and for example, the nucleotide sequence encoding mRNA of chicken Hba-a1 gene appears under accession number NM_001004376.2, and the amino acid sequence encoded by the nucleotide sequence appears under accession number NP_001004376.1.

"Col1a2" gene refers to "procollagen, type I, alpha 2" gene and sometimes also described as oim, Cola2, Cola-2, Col1a-2, AA960264, and AI325291. In the database of NCBI, for example, the nucleotide sequence encoding mRNA of mouse Col1a2 gene appears under accession number NM_007743.2, and the amino acid sequence encoded by the nucleotide sequence appears under accession number NP_031769.2. The nucleotide sequence encoding mRNA of human Col1a2 gene appears under accession number NM_000089.3, and the amino acid sequence encoded by the nucleotide sequence appears under accession number NP_000080.2. The nucleotide sequence encoding mRNA of chimpanzee Col1a2 gene appears under accession number XM_519207.2, and the amino acid sequence encoded by the nucleotide sequence appears under accession number XP_001168704.1. The nucleotide sequence encoding mRNA of canine Col1a2 gene appears under accession number NM_001003187.1, and the amino acid sequence encoded by the nucleotide sequence appears under accession number NP_001003187.1. The nucleotide sequence encoding mRNA of rat Col1a2 gene appears under accession number NM_053356.1, and the amino acid sequence encoded by the nucleotide sequence appears under accession number NP_445808.1. The nucleotide sequences of Col1a2 genes described above are shown in SEQ ID NOs: 71 to 75 of the present application. In addition, orthologous genes of the above-described genes also appear in the database of NCBI, and for example, the nucleotide sequence encoding mRNA of chicken Col1a2 gene appears under accession number XM_001234350.1, and the amino acid sequence encoded by the nucleotide sequence appears under accession number XP_001234351.1. The nucleotide sequence encoding mRNA of zebrafish Col1a2 gene appears under accession number NM_182968.2, and the amino acid sequence encoded by the nucleotide sequence appears under accession number NP_892013.2.

"Hba-x" gene refers to "hemoglobin X, alpha-like embryonic chain in Hba complex" gene and is sometimes also described as AI450015. In the database of NCBI, for example, the nucleotide sequence encoding mRNA of mouse Hba-x gene appears under accession number NM_010405.3, and the amino acid sequence encoded by the nucleotide sequence appears under accession number NP_034535.1. The nucleotide sequence encoding mRNA of human Hba-x gene appears under accession number NM_005332.2, and the amino acid sequence encoded by the nucleotide sequence appears under accession number NP_005323.1. The nucleotide sequence encoding mRNA of chimpanzee Hba-x gene appears under accession number XM_001151282.1, and the amino acid sequence encoded by the nucleotide sequence appears under accession number XP_001151282.1. The nucleotide sequences of Hba-x genes described above are shown in SEQ ID NOs: 76 to 78 of the present application. In addition, orthologous genes of the above-described genes also appear in the database of NCBI, and for example, the nucleotide sequence encoding mRNA of chicken Hba-x gene appears under accession number NM_001004374.1, and the amino acid sequence encoded by the nucleotide sequence appears under accession number NP_001004374.1.

"basp1" gene refers to "brain abundant, membrane attached signal" gene and is sometimes also described as 2610024P12Rik, CAP-23, CAP23, Ckap3, NAP-22, and NAP22. In the database of NCBI, for example, the nucleotide sequence encoding mRNA of human basp1 gene appears under accession number NM_006317.3, and the amino acid sequence encoded by the nucleotide sequence appears under accession number NP_006308.3. The nucleotide sequence encoding mRNA of chimpanzee basp1 gene appears under accession number XM_001175409.1, and the amino acid sequence encoded by the nucleotide sequence appears under accession number XP_001175409.1. The nucleotide sequence encoding mRNA of canine basp1 gene appears under accession number XM_863690.1, and the amino acid sequence encoded by the nucleotide sequence appears under accession number XP_868783.1. The nucleotide sequence encoding mRNA of bovine basp1 gene appears under accession number NM_174780.3, and the amino acid sequence encoded by the nucleotide sequence appears under accession number NP_777205.1. The nucleotide sequence encoding mRNA of mouse basp1 gene appears under accession number NM_027395.1, and the amino acid sequence encoded by the nucleotide sequence appears under accession number NP_081671.1. The nucleotide sequence encoding mRNA of rat basp1 gene appears under accession number NM_022300.1, and the amino acid sequence encoded by the nucleotide sequence appears under accession number NP_071636.1. The nucleotide sequences of basp1 genes described above are shown in SEQ ID NOs: 101 to 106 of the present application.

"cpe" gene refers to "carboxypeptidase E" gene and is sometimes also described as CPH, Cph-1, Cph1, MGC7101, R74677, and Fat. In the database of NCBI, for example, the nucleotide sequence encoding mRNA of human cpe gene appears under accession number NM_001873.2, and the amino acid sequence encoded by the nucleotide sequence appears under accession number NP_001864.1. The nucleotide sequence encoding mRNA of chimpanzee cpe gene appears under accession number NM_001098559.1, and the amino acid sequence encoded by the nucleotide sequence appears under accession number NP_001092029.1. The nucleotide sequence encoding mRNA of canine cpe gene appears under accession number XM_532715.2, and the amino acid sequence encoded by the nucleotide sequence appears under accession number XP_532715.2. The nucleotide sequence encoding mRNA of mouse cpe gene appears under accession number NM_013494.3, and the amino acid sequence encoded by the nucleotide sequence appears under accession number NP_038522.2. The nucleotide sequences of cpe genes described above are shown in SEQ ID NOs: 107 to 110 of the present application.

"ddr1" gene refers to "discoidin domain receptor family, member 1" gene and is sometimes also described as 6030432F18, AI323681, CD167a, Cak, Nep, and PTK3A. In the database of NCBI, for example, the nucleotide sequence encoding mRNA of isoform a of human ddr1 gene appears under accession number NM_013993.2, the amino acid sequence encoded by the nucleotide sequence appears under accession number NP_054699.2, the nucleotide sequence encoding mRNA of isoform b appears under accession number NM_001954.4, the amino acid sequence encoded by the nucleotide sequence appears under accession number NP_001945.3, the nucleotide sequence encoding mRNA of isoform c appears under accession number NM_013994.2, and the amino acid sequence encoded by the nucleotide sequence appears under accession number NP_054700.2. The nucleotide sequence encoding mRNA of chimpanzee ddr1 gene appears under accession number NM_001045502.1, and the amino acid sequence encoded by the nucleotide sequence appears under accession number NP_001038967.1. The nucleotide sequence encoding mRNA of canine ddr1 gene appears under accession number XM_532062.2, and the amino acid sequence encoded by the nucleotide sequence appears under accession number XP_532062.2. The nucleotide sequence encoding mRNA of bovine ddr1 gene appears under accession number NM_001076012.2, and the amino acid sequence encoded by the nucleotide sequence appears under accession number NP_001069480.2. The nucleotide sequence encoding mRNA of isoform 1 of mouse ddr1 gene appears under accession number NM_007584.2, the amino acid sequence encoded by the nucleotide sequence appears under accession number NP_031610.1, the nucleotide sequence encoding mRNA of isoform 2 appears under accession number NM_172962.1, and the amino acid sequence encoded by the nucleotide sequence appears under accession number NP_766550.1. The nucleotide sequence encoding mRNA of rat ddr1 gene appears under accession number NM_013137.1, and the amino acid sequence encoded by the nucleotide sequence appears under accession number NP_037269.1. The nucleotide sequences of ddr1 genes described above are shown in SEQ ID NOs: 111 to 119 of the present application.

"marcks" gene refers to "myristoylated alanine-rich protein kinase C substrate" gene and is sometimes also described as Macs and PKCSL. In the database of NCBI, for example, the nucleotide sequence encoding mRNA of human marcks gene appears under accession number NM_002356.5, and the amino acid sequence encoded by the nucleotide sequence appears under accession number NP_002347.5. The nucleotide sequence encoding mRNA of chimpanzee marcks gene appears under accession number XM_001159872.1, and the amino acid sequence encoded by the nucleotide sequence appears under accession number XP_001159872.1. The nucleotide sequence encoding mRNA of canine marcks gene appears under accession number XM_850164.1, and the amino acid sequence encoded by the nucleotide sequence appears under accession number XP_855257.1. The nucleotide sequence encoding mRNA of bovine marcks gene appears under accession number NM_001076276.1, and the amino acid sequence encoded by the nucleotide sequence appears under accession number NP_001069744.1. The nucleotide sequence encoding mRNA of mouse marcks gene appears under accession number NM_008538.2, and the amino acid sequence encoded by the nucleotide sequence appears under accession number NP_032564.1. The nucleotide sequence encoding mRNA of rat marcks gene appears under accession number XM_001060954.1, and the amino acid sequence encoded by the nucleotide sequence appears under accession number XP_001060954.1. The nucleotide sequences of marcks genes described above are shown in SEQ ID NOs: 120 to 125 of the present application.

"ndn" gene refers to "necdin" gene and is sometimes also described as AI528698 and Peg6. In the database of NCBI, for example, the nucleotide sequence encoding mRNA of human ndn gene appears under accession number NM_002487.2, and the amino acid sequence encoded by the nucleotide sequence appears under accession number NP_002478.1. The nucleotide sequence encoding mRNA of chimpanzee ndn gene appears under accession number XM_510257.2, and the amino acid sequence encoded by the nucleotide sequence appears under accession number XP_510257.2. The nucleotide sequence encoding mRNA of canine ndn gene appears under accession number XM_545810.2, and the amino acid sequence encoded by the nucleotide sequence appears under accession number XP_545810.1. The nucleotide sequence encoding mRNA of bovine ndn gene appears under accession number NM_001014982.1, and the amino acid sequence encoded by the nucleotide sequence appears under accession number NP_001014982.1. The nucleotide sequence encoding mRNA of mouse ndn gene appears under accession number NM_010882.3, and the amino acid sequence encoded by the nucleotide sequence appears under accession number NP_035012.2. The nucleotide sequence encoding mRNA of rat ndn gene appears under accession number NM_001008558.1, and the amino acid sequence encoded by the nucleotide sequence appears under accession number NP_001008558.1. The nucleotide sequences of ndn genes described above are shown in SEQ ID NOs: 126 to 131 of the present application.

"nnat" gene refers to "neuronatin" gene and is sometimes also described as 5730414102Rik, AW107673, Peg5, and RP23-169M4.6. In the database of NCBI, for example, the nucleotide sequence encoding mRNA of isoform a of human nnat gene appears under accession number NM_005386.2, the amino acid sequence encoded by the nucleotide sequence appears under accession number NP_005377.1, the nucleotide sequence encoding mRNA of isoform b appears under accession number NM_181689.1, and the amino acid sequence encoded by the nucleotide sequence appears under accession number NP_859017.1. The nucleotide sequence encoding mRNA of chimpanzee nnat gene appears under accession number XM_001141473.1, and the amino acid sequence encoded by the nucleotide sequence appears under accession number XP_001141473.1. The nucleotide sequence encoding mRNA of canine nnat gene appears under accession number XM_847444.1, and the amino acid sequence encoded by the nucleotide sequence appears under accession number XP_852537.1. The nucleotide sequence encoding mRNA of isoform a of mouse nnat gene appears under accession number NM_010923.2, the amino acid sequence encoded by the nucleotide sequence appears under accession number NP_035053.1, the nucleotide sequence encoding mRNA of isoform b appears under accession number NM_180960.2, and the amino acid sequence encoded by the nucleotide sequence appears under accession number NP_851291.1. The nucleotide sequence encoding mRNA of isoform a of rat nnat gene appears under accession number NM_053601.1, the amino acid sequence encoded by the nucleotide sequence appears under accession number NP_446053.1, the nucleotide sequence encoding mRNA of isoform b appears under accession number NM_181687.1, and the amino acid sequence encoded by the nucleotide sequence appears under accession number NP_859015.1. The nucleotide sequences of nnat genes described above are shown in SEQ ID NOs: 132 to 139 of the present application.

"ptbp2" gene refers to "polypyrimidine tract binding protein 2" gene and is sometimes also described as Ptb2, brPTB, and nPTB. In the database of NCBI, for example, the nucleotide sequence encoding mRNA of human ptbp2 gene appears under accession number NM_021190.2, and the amino acid sequence encoded by the nucleotide sequence appears under accession number NP_067013.1. The nucleotide sequence encoding mRNA of chimpanzee ptbp2 gene appears under accession number XM_001157727.1, and the amino acid sequence encoded by the nucleotide sequence appears under accession number XP_001157727.1. The nucleotide sequence encoding mRNA of canine ptbp2 gene appears under accession number XM_861727.1, and the amino acid sequence encoded by the nucleotide sequence appears under accession number XP_866820.1. The nucleotide sequence encoding mRNA of bovine ptbp2 gene appears under accession number NM_001110081.1, and the amino acid sequence encoded by the nucleotide sequence appears under accession number NP_001103551.1. The nucleotide sequence encoding mRNA of mouse ptbp2 gene appears under accession number NM_019550.1, and the amino acid sequence encoded by the nucleotide sequence appears under accession number NP_062423.1. The nucleotide sequence encoding mRNA of rat ptbp2 gene appears under accession number NM_001005555.1, and the amino acid sequence encoded by the nucleotide sequence appears under accession number NP_001005555.1. The nucleotide sequences of ptbp2 genes described above are shown in SEQ ID NOs: 140 to 145 of the present application.

"sfrp2" gene refers to "secreted frizzled-related protein 2" gene and is sometimes also described as AI851596 and Sdf5. In the database of NCBI, for example, the nucleotide sequence encoding mRNA of human sfrp2 gene appears under accession number NM_003013.2, and the amino acid sequence encoded by the nucleotide sequence appears under accession number NP_003004.1. The nucleotide sequence encoding mRNA of chimpanzee sfrp2 gene appears under accession number XM_001155803.1, and the amino acid sequence encoded by the nucleotide sequence appears under accession number XP_001155803.1. The nucleotide sequence encoding mRNA of canine sfrp2 gene appears under accession number NM_001002987.1, and the amino acid sequence encoded by the nucleotide sequence appears under accession number NP_001002987.1. The nucleotide sequence encoding mRNA of bovine sfrp2 gene appears under accession number NM_001034393.1, and the amino acid sequence encoded by the nucleotide sequence appears under accession number NP_001029565.1. The nucleotide sequence encoding mRNA of mouse sfrp2 gene appears under accession number NM_009144.2, and the amino acid sequence encoded by the nucleotide sequence appears under accession number NP_033170.1. The nucleotide sequence encoding mRNA of rat sfrp2 gene appears under accession number NM_001100700.1, and the amino acid sequence encoded by the nucleotide sequence appears under accession number NP_001094170.1. The nucleotide sequences of sfrp2 genes described above are shown in SEQ ID NOs: 146 to 151 of the present application.

"sox11" gene refers to "SRY-box 11" gene and is sometimes also described as 1110038H03Rik, 6230403H02Rik, AI836553, and end1. In the database of NCBI, for example, the nucleotide sequence encoding mRNA of human sox11 gene appears under accession number NM_003108.3, and the amino acid sequence encoded by the nucleotide sequence appears under accession number NP_003099.1. The nucleotide sequence encoding mRNA of bovine sox11 gene appears under accession number XM_001250191.1, and the amino acid sequence encoded by the nucleotide sequence appears under accession number XP_001250192.1. The nucleotide sequence encoding mRNA of mouse sox11 gene appears under accession number NM_009234.5, and the amino acid sequence encoded by the nucleotide sequence appears under accession number NP_033260.4. The nucleotide sequence encoding mRNA of rat sox11 gene appears under accession number NM_053349.1, and the amino acid sequence encoded by the nucleotide sequence appears under accession number NP_445801.1. The nucleotide sequences of sox11 genes described above are shown in SEQ ID NOs: 152 to 155 of the present application.

"ttc3" gene refers to "tetratricopeptide repeat domain 3" gene and is sometimes also described as 2610202A04Rik, AA409221, D16Ium21, D16Ium21e, KIAA4119, TPRD, and mKIAA4119. In the database of NCBI, for example, the nucleotide sequences encoding mRNA of human ttc3 gene appear under accession numbers NM_001001894.1 and NM_003316.3, and the amino acid sequences encoded by the nucleotide sequences appear under accession numbers NP_001001894.1 and NP_003307.3, respectively. The nucleotide sequence encoding mRNA of chimpanzee ttc3 gene appears under accession number XM_001169886.1, and the amino acid sequence encoded by the nucleotide sequence appears under accession number XP_001169886.1. The nucleotide sequence encoding mRNA of canine ttc3 gene appears under accession number XM_844474.1, and the amino acid sequence encoded by the nucleotide sequence appears under accession number XP_849567.1. The nucleotide sequence encoding mRNA of bovine ttc3 gene appears under accession number NM_001109767.2, and the amino acid sequence encoded by the nucleotide sequence appears under accession number NP_001103237.1. The nucleotide sequence encoding mRNA of mouse ttc3 gene appears under accession number NM_009441.2, and the amino acid sequence encoded by the nucleotide sequence appears under accession number NP_033467.2. The nucleotide sequence encoding mRNA of rat ttc3 gene appears under accession number NM_001108315.1, and the amino acid sequence encoded by the nucleotide sequence appears under accession number NP_001101785.1. The nucleotide sequences of ttc3 genes described above are shown in SEQ ID NOs: 156 to 162 of the present application.

"tubb2b" gene refers to "tubulin, beta 2b" gene and is sometimes also described as 2410129E14Rik. In the database of NCBI, for example, the nucleotide sequence encoding mRNA of mouse tubb2b gene appears under accession number NM_023716.2, and the amino acid sequence encoded by the nucleotide sequence appears under accession number NP_076205.1. The nucleotide sequence encoding mRNA of human tubb2b gene appears under accession number NM_178012.4, and the amino acid sequence encoded by the nucleotide sequence appears under accession number NP_821080.1. The nucleotide sequence encoding mRNA of chimpanzee tubb2b gene appears under accession number XM_001162039.1, and the amino acid sequence encoded by the nucleotide sequence appears under accession number XP_001162039.1. The nucleotide sequence encoding mRNA of canine tubb2b gene appears under accession number XM_851105.1, and the amino acid sequence encoded by the nucleotide sequence appears under accession number XP_856198.1. The nucleotide sequence encoding mRNA of rat tubb2b gene appears under accession number NM_001013886.2, and the amino acid sequence encoded by the nucleotide sequence appears under accession number NP_001013908.2. The nucleotide sequences of tubb2b genes described above are shown in SEQ ID NOs: 163 to 167 of the present application.

"ubqln2" gene refers to "ubiquitin 2" gene and is sometimes also described as Chap1, Dsk2, HRIHFB2157, Plic-2, Plic2, and RP23-240F13.1. In the database of NCBI, for example, the nucleotide sequence encoding mRNA of mouse ubqln2 gene appears under accession number NM_018798.2 and amino acid sequence accession number NP_061268.2. The nucleotide sequence encoding mRNA of human ubqln2 gene appears under accession number NM_013444.2, and the amino acid sequence encoded by the nucleotide sequence appears under accession number NP_038472.2. The nucleotide sequence encoding mRNA of chimpanzee ubqln2 gene appears under accession number XM_001148609.1, and the amino acid sequence encoded by the nucleotide sequence appears under accession number XP_001148609.1. The nucleotide sequence encoding mRNA of canine ubqln2 gene appears under accession number XM_549029.2, and the amino acid sequence encoded by the nucleotide sequence appears under accession number XP_549029.2. The nucleotide sequence encoding mRNA of bovine ubqln2 gene appears under accession number XM_587928.4, and the amino acid sequence encoded by the nucleotide sequence appears under accession number XP_587928.3. The nucleotide sequence encoding mRNA of rat ubqln2 gene appears under accession number XM_001061090.1, and the amino acid sequence encoded by the nucleotide sequence appears under accession number XP_001061090.1. The nucleotide sequences of ubqln2 genes described above are shown in SEQ ID NOs: 164 to 173 of the present application.

"vim" gene refers to "vimentin" gene and is sometimes also described as MGC102095 and RP23-185P20.1. In the database of NCBI, for example, the nucleotide sequence encoding mRNA of human vim gene appears under accession number NM_003380.2, and the amino acid sequence encoded by the nucleotide sequence appears under accession number NP_003371.2. The nucleotide sequence encoding mRNA of chimpanzee vim gene appears under accession number NM_001009148.1, and the amino acid sequence encoded by the nucleotide sequence appears under accession number NP_001009148.1. The nucleotide sequence encoding mRNA of canine vim gene appears under accession number XM_851385.1, and the amino acid sequence encoded by the nucleotide sequence appears under accession number XP_856478.1. The nucleotide sequence encoding mRNA of bovine vim gene appears under accession number NM_173969.3, and the amino acid sequence encoded by the nucleotide sequence appears under accession number NP_776394.2. The nucleotide sequence encoding mRNA of mouse vim gene appears under accession number NM_011701.3, and the amino acid sequence encoded by the nucleotide sequence appears under accession number NP_035831.2. The nucleotide sequence encoding mRNA of rat vim gene appears under accession number NM_031140.1, and the amino acid sequence encoded by the nucleotide sequence appears under accession number NP_112402.1. The nucleotide sequences of vim genes described above are shown in SEQ ID NOs: 174 to 179 of the present application.

"six3" gene refers to "sine oculis homeobox homolog 3" gene and is sometimes also described as Six3a, Six3alpha, Six3b, and Six3beta. In the database of NCBI, for example, the nucleotide sequence encoding mRNA of human six3 gene appears under accession number NM_005413.2, and the amino acid sequence encoded by the nucleotide sequence appears under accession number NP_005404.1. The nucleotide sequence encoding mRNA of chimpanzee six3 gene appears under accession number XM_525749.2, and the amino acid sequence encoded by the nucleotide sequence appears under accession number XP_525749.2. The nucleotide sequence encoding mRNA of bovine six3 gene appears under accession number XM_868863.3, and the amino acid sequence encoded by the nucleotide sequence appears under accession number XP_873956.2. The nucleotide sequence encoding mRNA of mouse six3 gene appears under accession number NM_011381.3, and the amino acid sequence encoded by the nucleotide sequence appears under accession number NP_035511.2. The nucleotide sequence encoding mRNA of rat six3 gene appears under accession number NM_023990.1, and the amino acid sequence encoded by the nucleotide sequence appears under accession number NP_076480.1. The nucleotide sequences of six3 genes described above are shown in SEQ ID NOs: 180 to 184 of the present application.

"arx" gene refers to "aristaless related homeobox" gene and is sometimes also described as RP23-53K18.1. In the database of NCBI, for example, the nucleotide sequence encoding mRNA of human arx gene appears under accession number NM_139058.2, and the amino acid sequence encoded by the nucleotide sequence appears under accession number NP_620689.1. The nucleotide sequence encoding mRNA of canine arx gene appears under accession number NM_001114666.1, and the amino acid sequence encoded by the nucleotide sequence appears under accession number NP_001108138.1. The nucleotide sequence encoding mRNA of mouse arx gene appears under accession number NM_007492.3, and the amino acid sequence encoded by the nucleotide sequence appears under accession number NP_031518.2. The nucleotide sequence encoding mRNA of rat arx gene appears under accession number NM_001100174.1, and the amino acid sequence encoded by the nucleotide sequence appears under accession number NP_001093644.1. The nucleotide sequences of arx genes described above are shown in SEQ ID NOs: 185 to 188 of the present application.

"dcx" gene refers to "doublecortin" gene and is sometimes also described as DBCN, DC, LISX, RP5-914P14.1, SCLH, and XLIS. In the database of NCBI, for example, the nucleotide sequence encoding mRNA of isoform a of human dcx gene appears under accession number NM_000555.2, the amino acid sequence encoded by the nucleotide sequence appears under accession number NP_000546.2, the nucleotide sequence encoding mRNA of isoform b appears under accession number NM_178152.1, the amino acid sequence encoded by the nucleotide sequence appears under accession number NP_835365.1, the nucleotide sequences encoding mRNA of isoform c appear under accession numbers NM_178151.1 and NM_178153.1, and the amino acid sequences encoded by the nucleotide sequences appear under accession numbers NP_835364.1 and NP_835366.1, respectively. The nucleotide sequence encoding mRNA of chimpanzee dcx gene appears under accession number XM_529107.2, and the amino acid sequence encoded by the nucleotide sequence appears under accession number XP_529107.2. The nucleotide sequence encoding mRNA of canine dcx gene appears under accession number XM_848089.1, the amino acid sequence encoded by the nucleotide sequence appears under accession number XP_853182.1, the nucleotide sequence encoding mRNA of rat dcx gene appears under accession number NM_053379.2, and the amino acid sequence encoded by the nucleotide sequence appears under accession number NP_445831.2. The nucleotide sequences encoding mRNA of isoform a of mouse dcx gene appear under accession numbers NM_001110222.1 and NM_001110223.1, the amino acid sequences encoded by the nucleotide sequences appear under accession numbers NP_001103692.1 and NP_001103693.1, respectively, the nucleotide sequence encoding mRNA of isoform b appears under accession number NM_001110224.1, the amino acid sequence encoded by the nucleotide sequence appears under accession number NP_001103694.1, the nucleotide sequence encoding mRNA of isoform c appears under accession number NM_010025.2, and the amino acid sequence encoded by the nucleotide sequence appears under accession number NP_034155.2. The nucleotide sequences of dcx genes described above are shown in SEQ ID NOs: 189 to 199 of the present application.

"L1cam" gene refers to "L1 cell adhesion molecule" gene and is sometimes also described as CAML1, CD171, HSAS, HSAS1, MASA, MIC5, N-CAML1, S10, and SPG1. In the database of NCBI, for example, the nucleotide sequence encoding mRNA of isoform 1 of human L1cam gene appears under accession number NM_000425.2, the amino acid sequence encoded by the nucleotide sequence appears under accession number NP_000416.1, the nucleotide sequence encoding mRNA of isoform 2 appears under accession number NM_024003.1, and the amino acid sequence encoded by the nucleotide sequence appears under accession number NP_076493.1. The nucleotide sequence encoding mRNA of chimpanzee L1cam gene appears under accession number XM_001139376.1, and the amino acid sequence encoded by the nucleotide sequence appears under accession number XP_001139376.1. The nucleotide sequence encoding mRNA of canine L1cam gene appears under accession number XM_549364.2, and the amino acid sequence encoded by the nucleotide sequence appears under accession number XP_549364.2. The nucleotide sequence encoding mRNA of bovine L1cam gene appears under accession number XM_001250423.1, and the amino acid sequence encoded by the nucleotide sequence appears under accession number XP_001250424.1. The nucleotide sequence encoding mRNA of mouse L1cam gene appears under accession number NM_008478.3, and the amino acid sequence encoded by the nucleotide sequence appears under accession number NP_032504.3. The nucleotide sequence encoding mRNA of rat L1cam gene appears under accession number NM_017345.1, and the amino acid sequence encoded by the nucleotide sequence appears under accession number NP_059041.1. The nucleotide sequences of L1cam genes described above are shown in SEQ ID NOs: 200 to 206 of the present application.

"emx2" gene refers to "empty spiracles homeobox 2" gene and is sometimes also described as Pdo. In the database of NCBI, for example, the nucleotide sequence encoding mRNA of human emx2 gene appears under accession number NM_004098.3, and the amino acid sequence encoded by the nucleotide sequence appears under accession number NP_004089.1. The nucleotide sequence encoding mRNA of chimpanzee emx2 gene appears under accession number XM_001152098.1, and the amino acid sequence encoded by the nucleotide sequence appears under accession number XP_001152098.1. The nucleotide sequence encoding mRNA of canine emx2 gene appears under accession number XM_848240.1, and the amino acid sequence encoded by the nucleotide sequence appears under accession number XP_853333.1. The nucleotide sequence encoding mRNA of bovine emx2 gene appears under accession number NM_001075845.1, and the amino acid sequence encoded by the nucleotide sequence appears under accession number NP_001069313.1. The nucleotide sequence encoding mRNA of mouse emx2 gene appears under accession number NM_010132.2, and the amino acid sequence encoded by the nucleotide sequence appears under accession number NP_034262.2. The nucleotide sequence encoding mRNA of rat emx2 gene appears under accession number NM_001109169.1, and the amino acid sequence encoded by the nucleotide sequence appears under accession number NP_001102639.1. The nucleotide sequences of emx2 genes described above are shown in SEQ ID NOs: 207 to 212 of the present application.

"wnt1" gene refers to "wingless-type MMTV integration site family, member 1" gene and is sometimes also described as Int-1, Wnt-1, sw, and swaying. In the database of NCBI, for example, the nucleotide sequence encoding mRNA of human wnt1 gene appears under accession number NM_005430.2, and the amino acid sequence encoded by the nucleotide sequence appears under accession number NP_005421.1. The nucleotide sequence encoding mRNA of chimpanzee wnt1 gene appears under accession number XM_001159566.1, and the amino acid sequence encoded by the nucleotide sequence appears under accession number XP_001159566.1. The nucleotide sequence encoding mRNA of canine wnt1 gene appears under accession number XM_543686.2, and the amino acid sequence encoded by the nucleotide sequence appears under accession number XP_543686.2. The nucleotide sequence encoding mRNA of bovine wnt1 gene appears under accession number NM_001114191.1, and the amino acid sequence encoded by the nucleotide sequence appears under accession number NP_001107663.1. The nucleotide sequence encoding mRNA of mouse wnt1 gene appears under accession number NM_021279.4, and the amino acid sequence encoded by the nucleotide sequence appears under accession number NP_067254.1. The nucleotide sequence encoding mRNA of rat wnt1 gene appears under accession number NM_001105714.1, and the amino acid sequence encoded by the nucleotide sequence appears under accession number NP_001099184.1. The nucleotide sequences of wnt1 genes described above are shown in SEQ ID NOs: 213 to 218 of the present application.

"reln gene" refers to "reelin" gene and is sometimes also described as reeler and rl. In the database of NCBI, for example, the nucleotide sequence encoding mRNA of isoform a of human reln gene appears under accession number NM_005045.2, the amino acid sequence encoded by the nucleotide sequence appears under accession number NP_005036.2, the nucleotide sequence encoding mRNA of isoform b appears under accession number NM_173054.1, and the amino acid sequence encoded by the nucleotide sequence appears under accession number NP_774959.1. The nucleotide sequence encoding mRNA of chimpanzee reln gene appears under accession number XM_519291.2, and the amino acid sequence encoded by the nucleotide sequence appears under accession number XP_519291.2. The nucleotide sequence encoding mRNA of canine rein gene appears under accession number XM_844371.1, and the amino acid sequence encoded by the nucleotide sequence appears under accession number XP_849464.1. The nucleotide sequence encoding mRNA of bovine rein gene appears under accession number NM_001105321.1, and the amino acid sequence encoded by the nucleotide sequence appears under accession number NP_001098791.1. The nucleotide sequence encoding mRNA of mouse rein gene appears under accession number NM_011261.1, and the amino acid sequence encoded by the nucleotide sequence appears under accession number NP_035391.2. The nucleotide sequence encoding mRNA of rat rein gene appears under accession number NM_080394.2, and the amino acid sequence encoded by the nucleotide sequence appears under accession number NP_536319.2. The nucleotide sequences of rein genes described above are shown in SEQ ID NOs: 219 to 225 of the present application.

"pax6" gene refers to "paired box 6" gene and is sometimes also described as AN, AN2, MGDA, WAGR, D11S812E, MGC17209, Dey, Sey, AEY11, Gsfaey11, and 1500038E17Rik. In the database of NCBI, for example, the nucleotide sequence encoding mRNA of mouse pax6 gene appears under accession number NM_013627.4, and the amino acid sequence encoded by the nucleotide sequence appears under accession number NP_038655.1. The nucleotide sequences encoding mRNA of isoform a of human pax6 gene appear under accession numbers NM_000280.3 and NM_001127612.1, the amino acid sequences encoded by the nucleotide sequence appear under accession numbers NP_000271.1 and NP_001121084.1, respectively, the nucleotide sequence encoding mRNA of isoform b appears under accession number NM_001604.3, and the amino acid sequence encoded by the nucleotide sequence appears under accession number NP_001595.2. The nucleotide sequence encoding mRNA of rat pax6 gene appears under accession number NM_013001.2, and the amino acid sequence encoded by the nucleotide sequence appears under accession number NP_037133.1. The nucleotide sequences of pax6 genes described above are shown in SEQ ID NOs: 226 to 230 of the present application.

In addition, the present invention is a method for obtaining a marker gene for assessing embryotoxicity of a chemical comprising:

(1) a step A of measuring the expression level of a gene comprising any of the nucleotide sequences of SEQ ID NOs: 1 to 78 and 101 to 230 in a specific tissue cell that has come into contact with a test chemical during differentiation of a stem cell into the tissue cell;

(2) a step B of comparing the measured value of the expression level of the gene in the step A with a control value of the expression level of the gene and based on the difference, identifying another gene which shows alteration specific to the test chemical; and (3) a step C of obtaining the gene identified in the step B.

In the step A, specifically, for example, cells in the differentiation process to the tissue which have come into contact with a chemical showing embryotoxicity or a plurality of chemicals showing no embryotoxicity are sequentially obtained and the expression level of a gene comprising any of the nucleotide sequences of SEQ ID NOs: 1 to 78 and 101 to 230 is measured.

In the step B, cells in the differentiation process to the tissue which have not come into contact with a chemical are sequentially obtained and the expression level of the gene is measured to use as a control value, and a pattern of the difference in the altered expression of the gene for each chemical is elucidated as compared to the gene expression level in the step A at each time point. Moreover, identified as a marker gene for assessing embryotoxicity is another gene which shows a pattern of altered gene expression specific to a plurality of chemicals is the same as the pattern of altered expression of the above gene.

In the step C, a gene identified in the step B is obtained by such method as PCR method.

In addition, the present invention is a method for obtaining a marker gene for assessing embryotoxicity of a chemical comprising:

(1) a step A of measuring alteration during differentiation in the expression of a gene that comprises any of the nucleotide sequences of SEQ ID NOs: 1 to 78 and 101 to 230 during differentiation of a stem cell into a specific tissue cell and identifying a gene with altered expression;

(2) a step B of measuring the expression level of the gene identified in the step A in the tissue cell which has come into contact with a test chemical; and (3) a step C of comparing the measured value of the expression level of the gene in the step B with a control value of the expression level of the gene and based on the difference, identifying and obtaining another gene that shows alteration specific to the test chemical.

In the step A, measured is the expression level of a gene comprising any of the nucleotide sequences of SEQ ID NOs: 1 to 78 and 101 to 230 in the tissue cells sequentially obtained during differentiation of stem cells into specific tissue cells. Specifically, for example, cells in the differentiation process to the tissue are sequentially obtained and the expression level of the gene is measured, and identified is a gene expression of which significantly alters as compared to the expression level at day 0. In the step B, measured for the gene identified in the step A is the expression level in the tissue cells which have come into contact with a chemical showing embryotoxicity or a plurality of chemicals showing no embryotoxicity in an animal. In the step C, cells in the differentiation process to the tissue which have not come into contact with a chemical are sequentially obtained and the expression level of the gene is measured to use as a control value, and a pattern of the difference in the altered expression of the gene for each chemical is elucidated as compared to the gene expression level in the step B at each time point. Moreover, identified as a marker gene for assessing embryotoxicity is another gene which shows a pattern of altered gene expression specific to a plurality of chemicals is the same as the pattern of altered expression of the specified gene.

As used herein, "reporter gene" contains a promoter sequence of the present gene and a reporter protein coding sequence operably linked to the promoter sequence. Examples of the reporter protein include enzymes such as firefly luciferase (firefly luc), renilla luciferase (renilla luc), β-galactosidase, and chloramphenicol acetyltransferase, and selectable marker proteins that allow visual selection in a host to which a nucleic acid construct is introduced. Examples of the selectable marker proteins described above include fluorescent dye markers and dye markers capable of observation in living cells, such as green fluorescent protein (GFP), cyan fluorescent protein (CFP), yellow fluorescent protein (YFP) and red fluorescent protein (dsRed). It is preferred that the reporter protein does not substantially show toxicity to a host into which the nucleic acid construct of the present invention is introduced. In addition, the detection of the reporter gene expression can be carried out by a known detection method even when the reporter protein is an enzyme or fluorescent protein.

As used herein, "promoter" refers to a region on DNA that determines the initiation site of transcription of a gene and directly regulates the frequency of transcription, and is a nucleotide sequence that typically starts transcription by binding of RNA polymerase. Therefore, a portion having an action of the promoter of a gene is herein referred to as "promoter sequence." The sequence of a promoter is typically a region within about 5 kbp upstream of the first exon of a putative protein coding region. Therefore, it is possible to estimate a promoter sequence by predicting a protein coding region in a genomic nucleotide sequence using a DNA analyzing software. As the DNA analyzing software, for example, DNASIS software (Hitachi Software), GENETYX (GENETYX CORPORATION), and the like can be used. A putative promoter sequence differs depending on the structural gene and is typically located in the upstream of a structural gene, but can be located in the downstream of a structural gene.

As used herein, a method for obtaining a DNA sequence anticipated as a promoter sequence from the NCBI database is specifically described using mouse Hand1 gene as an example. As for the mRNA sequence of mouse Hand1 gene, by searching in the NCBI website on the internet using "hand1" as a keyword, the nucleotide sequence registered under accession number NM_008213.2 can be obtained. Next, according to a blast search for mouse complete genomic sequence, among the sequences registered under NM_008213.2, a genomic sequence containing a homologous sequence to the sequence surrounding the transcription start point is searched. As a result, from the whole sequence of mouse 11th chromosome under accession number ref|NT_096135.5|Mm11_95772_37, the genomic information of 1 Mbp around the Hand1 gene can be known. After the indicated range is narrowed down to 10 kbp or so, the genomic sequence of 10 kbp or so around the Hand1 gene can be obtained by directing downloading. The resulting genomic sequence and mRNA sequence are analyzed using a DNA analyzing software, whereby the DNA sequence of about 5 kbp upstream from the transcription start point can be obtained. As the DNA analyzing software, for example, DNASIS software (Hitachi Software), GENETYX (GENETYX CORPORATION), and the like can be used.

As used herein, the term "operably linked to a promoter sequence" indicates that expression (operation) of a desired gene is under control of a promoter sequence. In order for a promoter to be operably linked to a structural gene, typically, the promoter is located immediately upstream of the structural gene, but is not necessarily located adjacent to the structural gene. In a reporter gene containing a promoter sequence of the present gene and a reporter protein coding sequence operably linked to the promoter sequence, such promoter sequence may be a region located between 5 kbp upstream from the transcription start point of the sequence. It is because this region is expected to contain a bindable sequence in known transcription regulator such as Sp1 and AP-2 and play an important roll for expression control. Based on the above, it is assumed that at least nucleotide sequence (promoter sequence) necessary and sufficient for inducing transcription into these regions is contained. A promoter sequence may be operably linked to a reporter protein coding sequence to function and is not limited by length.

When mentioning genes herein, "vector" refers to a vector capable of transferring a polynucleotide sequence of interest to a target cell. Examples of such a vector include those capable of self replication or incorporation into a chromosome in a host cell such as a prokaryotic cell, yeast, an animal cell, a plant cell, an insect cell, an individual animal, and an individual plant, and contain a promoter at a site suitable for transcription of a polynucleotide of the present invention. Among vectors, a vector suitable for cloning is referred to as "cloning vector." Such a cloning vector typically contains a multiple cloning site containing a plurality of restriction enzyme sites. At present, there are a number of vectors available for cloning genes in the art, which are designated different names by distributors depending on structural differences (e.g., the type or sequence of a restriction enzyme for multicloning sites). For example, representative cloning vectors are described in "Molecular Cloning (3rd edition)" by Sambrook, J and Russell, D. W., Appendix 3 (Volume 3), Vectors and Bacterial strains. A3.2 (Cold Spring Harbor USA, 2001)) (sales agencies are also described therein) and can be used as appropriate by those skilled in the art depending on the purpose.

As used herein, "vector" also contains "expression vector," "reporter vector," and "recombinant vector," and in the "expression vector," in addition to a structural gene and a promoter for regulating the expression thereof, various regulatory elements may be linked in a state that allows them to operate within host cells. The regulatory elements may include, preferably, terminators, selectable markers such as drug-resistant genes, and enhancers. It is a well-known matter to those skilled in the art that the type of an expression vector of a living organism (e.g., animal) and the type of regulatory element used may vary depending on the host cell.

As a "recombinant vector" used herein, for example, a lambda FIX vector (phage vector) can be used for screening genome libraries, and a lambda ZAP vector (phage vector) can be used for screening cDNA. For cloning genomic DNA, pBluescript II SK+/−, pGEM, and pCR2.1 vectors (plasmid vectors), and the like can be used. As an expression vector, a pSV2neo vector, a pcDNA vector, a pUC18 vector, a pUC19 vector, a pRc/RSV vector, a pLenti6/V5-Dest vector, a pAd/CMV/V5-DEST vector, a pDON-AI-2/neo vector, a pMEI-5/neo vector, and the like (plasmid vectors) can be used. As a reporter vector, a pGL2 vector, a pGL3 vector, a pGL4.10 vector, a pGL4.11 vector, a pGL4.12 vector, a pGL4.70 vector, a pGL4.71 vector, a pGL4.72 vector, a pSLG vector, a pSLO vector, a pSLR vector, a pEGFP vector, a pAcGFP vector, a pDsRed vector, and the like can be used. Such vectors can be used as appropriate with reference to the above-mentioned Molecular Cloning (supra).

Examples of techniques for introduction of a nucleic acid molecule into cells used herein include transformation, transduction, transfection, and the like. Such nucleic acid molecule introduction techniques are well-known in the art and commonly used, and are described in, for example, edited by Ausubel F. A. et al. (1988), Current Protocols in Molecular Biology, Wiley, New York, N.Y.; Sambrook J. et al. (1987) Molecular Cloning: A Laboratory Manual, 2nd Ed. and its 3rd Ed., Cold Spring Harbor Laboratory Press, Cold Spring Harbor, N.Y.; Special issue, Jikken Igaku [Experimental Medicine] "Experimental Method for Gene introduction & Expression Analysis," Yodo-sha, 1997; and the like. Gene Introduction can be confirmed using the method as described herein, such as Northern blotting analysis and Western blotting analysis, or other well-known common techniques.

Any of the above-described methods for introducing DNA into cells can be used as a vector introduction method, including, for example, transfection, transduction, transformation, and the like (e.g., a calcium phosphate method, a liposome method, a DEAE dextran method, an electroporation method, a particle gun (gene gun) method, and the like).

"Transformant" refers to the whole or a part of an organism, such as a cell which is produced by transformation. Examples of a transformant include a prokaryotic cell, yeast, an animal cell, a plant cell, and an insect cell. Transformants are also referred to as transformed cells, transformed tissue, transformed hosts, or the like, depending on the subject. The cell used in the present invention may be a transformant.

When a prokaryotic cell is used herein for genetic manipulations or the like, examples of the prokaryotic cell include prokaryotic cells belonging to the genus *Eschericia*, genus *Serratia*, genus *Bacillus*, genus *Brevibacterium*, genus *Corynebacterium*, genus *Microbacterium*, genus *Pseudomonas*, and the like, for example, *Eschericia* XL1-Blue, *Eschericia* XL2-Blue, *Eschericia* DH1, and the like and are described in "Molecular Cloning (3rd edition)" by Sambrook, J and Russell, D. W., Appendix 3 (Volume 3), Vectors and Bacterial strains. A3.2 (Cold Spring Harbor USA, 2001).

As used herein, "genetically modified non-human animal" is a collective term of transgenic non-human animals (mouse, rat) created by introducing a specific gene (DNA) from external by a genetic manipulation, knockout mice generated by deleting a specific gene by disruption, conversely, knockin mice generated by the addition and substitution to a specific gene, and the like.

EXAMPLES

Hereinafter, the present invention will be described in more detail by reference to Examples, but the present invention is not limited to such Examples.

Example 1

Induction of ES Cell Differentiation into Myocardium

Mouse ES cells (ES-D3 strain) were obtained from ATCC (American Type Culture Collection). The ES-D3 strain was cultured while maintaining an undifferentiated state in DMEM medium containing 15% heat inactivated fetal bovine serum supplemented with mouse LIF (leukemia inhibitory factor), and thereafter, the cells were dispersed using 0.25% trypsin/1 mM EDTA. Using a medium containing 15% heat inactivated fetal bovine serum not containing LIF, the cells were cultured by hanging drop culture in a dish with a diameter of 10 cm, so as to contain about 750 cells per droplet (this culture method is also called as hanging drop culture or hanging drop method) in an incubator at 37° C. and 5% $CO_2$ for 3 days, to form embryoid bodies. This embryoid bodies were further cultured in suspension in a nonadherent petri dish for 2 days and then transferred to an adherent petri dish. At 10 days after the start of the hanging drop, cardiomyocytes that repeat contractions were confirmed under a microscope. In order to sequentially and exhaustively figure out a gene in which expression varies in a process of differentiation from ES cells into cardiac muscle, the hanging drop culture of over 12,000 droplets were started. On each at day 0, day 1, day 2, day 3, day 4, day 5, day 6, day 7, day 8, day 9, and day 10 in the process of differentiation induction described above, 50 or more cells were collected, mixed, and defined as 1 group, and more than 4 groups of the cells were collected.

This procedure was carried out until day 10.

Example 2

Analysis of Global Changes in Expression During Myocardial Differentiation

RNA was extracted from a total of 24 samples, at a total of 6 time points, day 0, day 2, day 4, day 6, day 8, and day 10 after differentiation induction (4 groups per day) using an RNeasy RNA extraction kit (QIAGEN). The concentration measurement with a RiboGreen RNA quantification kit (Invitrogen) and the quality confirmation of RNA degradation by electrophoresis were carried out for all the extracted RNA. Using RNA prepared as 4 µg based on the result of the concentration measurement, gene expression alteration profile data was exhaustively collected using a GeneChip Mouse Genome 430 2.0 Array (Affymetrix) and analyzed. As a specific analysis method, genes expression of which commonly alters in all groups at each time point were first extracted using Bioinformatics analysis software. Subsequently, expression pattern classification was sequentially performed to group the extracted genes. Hand1 gene, ADAM19 gene, Cmya1 gene, Pitx2 gene, Smyd1 gene, Pim2 gene, Tbx20 gene, Myl4 gene, Myl7 gene, Hbb-bh1 gene, Hba-a1 gene, Col1a2 gene, or Hba-x gene that showed expression alteration at each day (day 2, day 4, day 6, day 8, and day 10) against day 0 was extracted as a candidate gene.

Example 3

A method for analyzing alteration in the expression level of the candidate gene by qualitative PCR using embryotoxic and non-embryotoxic chemicals to identify a marker gene will be described.
(Collection of Sample Contacted with Test Chemical on Induction of Myocardial Differentiation)

The ES-D3 cell line was cultured while maintaining an undifferentiated state in DMEM medium containing 15% heat inactivated fetal bovine serum supplemented with LIF in an incubator at 37° C. and 5% $CO_2$. In the differentiation induction method, first, the cells were dispersed using 0.25% trypsin/1 mM EDTA, and thereafter, using a medium containing 15% heat inactivated fetal bovine serum not containing LIF, the cells were cultured for 3 days by hanging drop culture in a petri dish with a diameter of 10 cm, so as to contain about 750 cells per droplet. The formed embryoid bodies were further cultured in suspension in a nonadherent 6 cm petri dish (greiner) for 2 days, and thereafter, the embryoid bodies were seeded in a 24-well plate (BD Falcon). The series of differentiation induction described above was performed in a medium supplemented with a solvent control group, groups treated with an embryotoxic chemical (0.05 µg/mL 5-Fluorouracil, 4.0 µg/mL hydroxyurea, or 1.0 µg/mL 6-aminonicotinamide), and groups treated with a non-embryotoxic chemical (1,000 µg/mL saccharin sodium hydrate, 7.5 µg/mL ascorbic acid, or 125 µg/mL isoniazide). 10 days of culture was performed replacing with a medium supplemented with a compound prepared again at day 3 and day 5 from the start of the hanging drop. On each at day 1, day 2, day 3, day 4, day 5, day 6, day 7, day 8, day 9, and day 10 from the start of the hanging drop, 50 or more cells were collected, mixed, and defined as 1 group, and more than 4 groups of the cells were collected. The collected cells were dissolved in 100 µl of Trisol solution (Invitrogen) and stored at −80° C. RNA was extracted from a stored sample according to the conventional method and then purified with an RNeasy mini kit (QIAGEN).
(Expression Analysis of Candidate Gene by Quantitative PCR)

Figure 2:
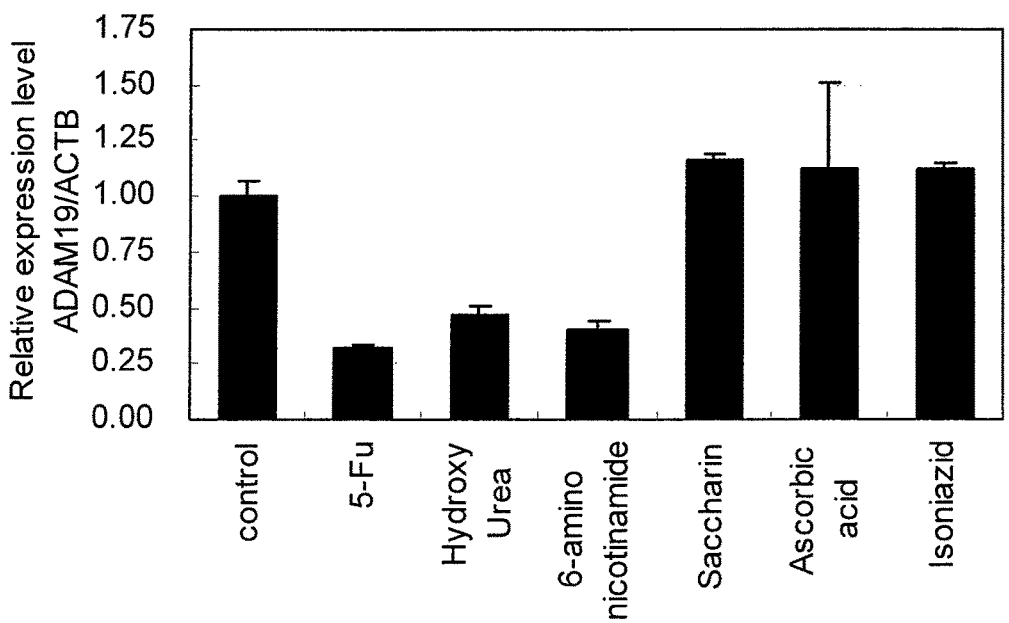
Figure 3:
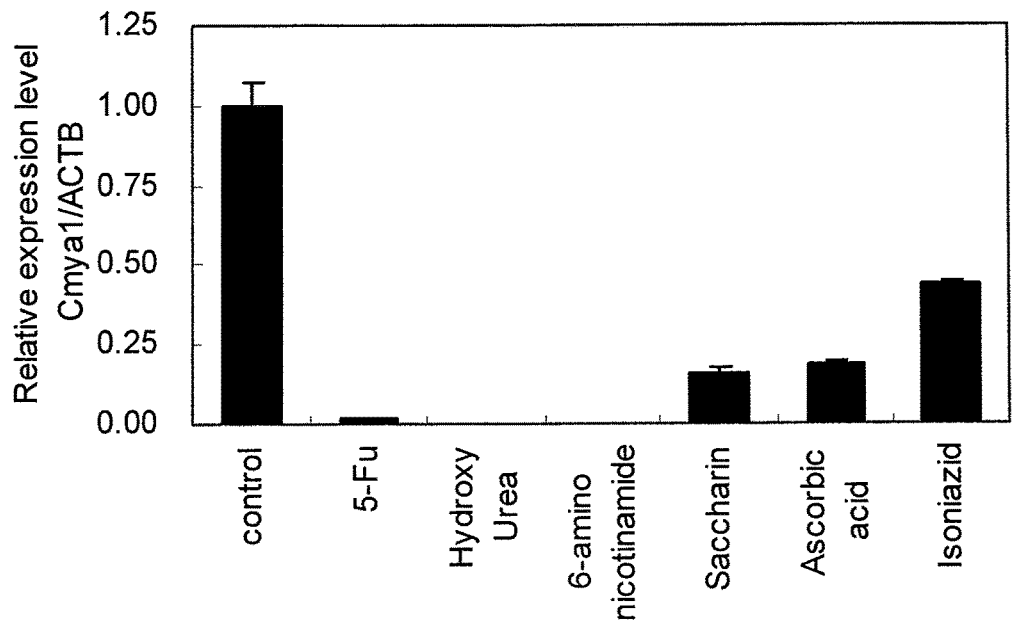
Figure 4:
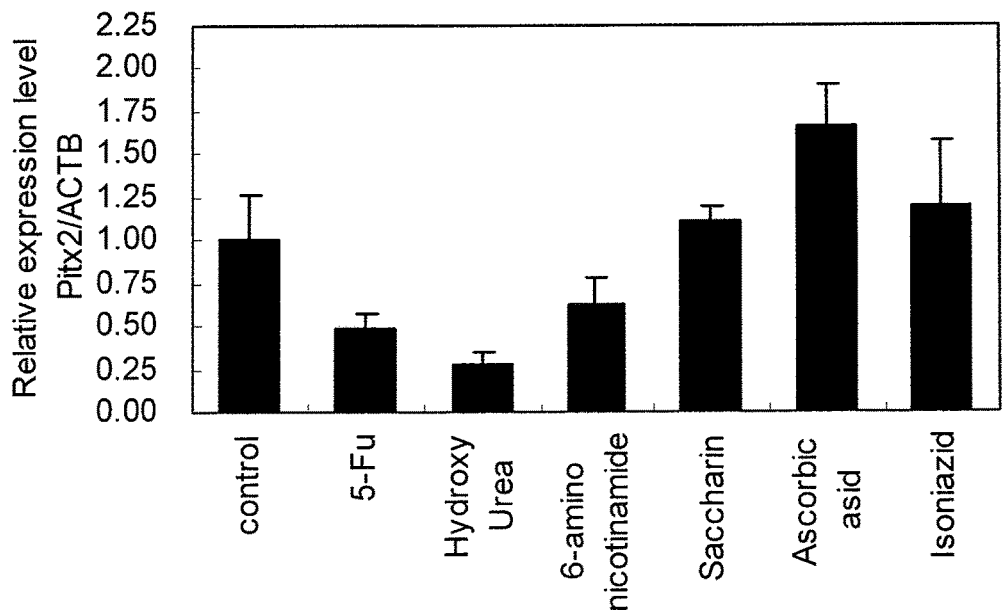
Figure 5:
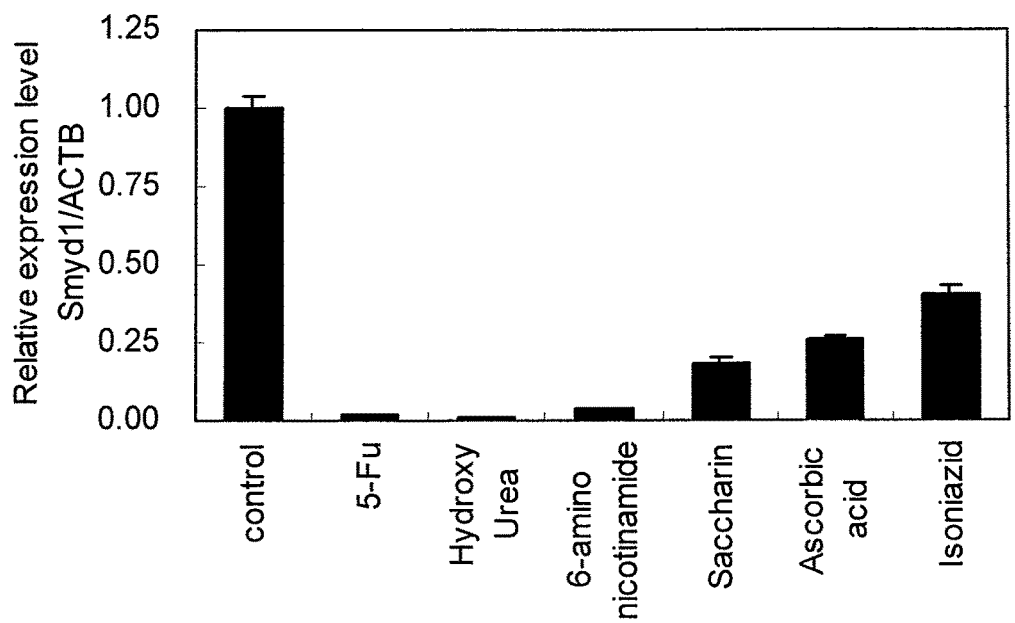
Figure 6:
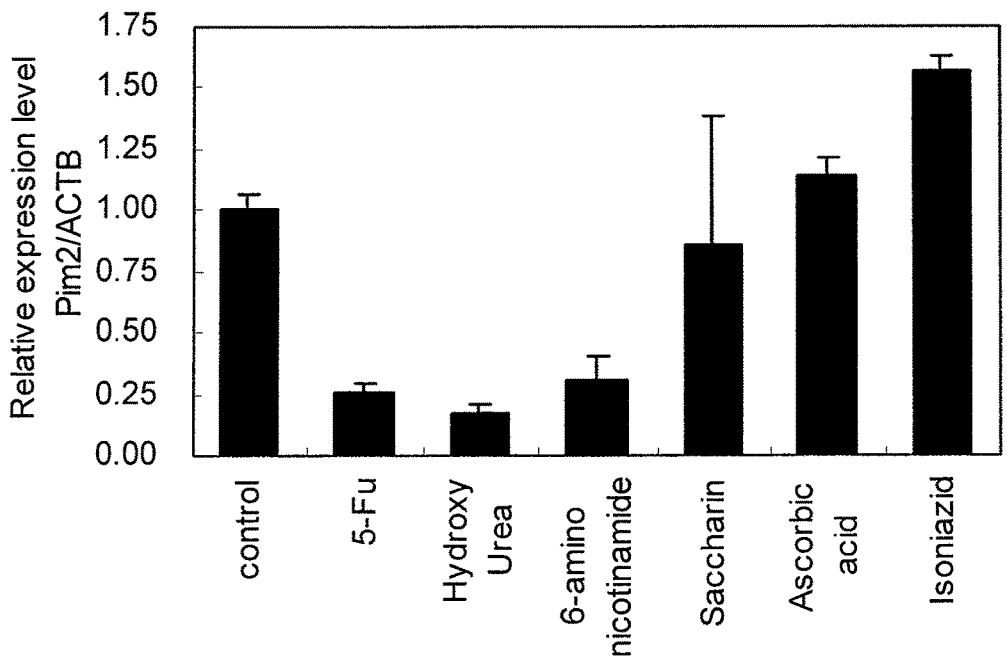
Figure 7:
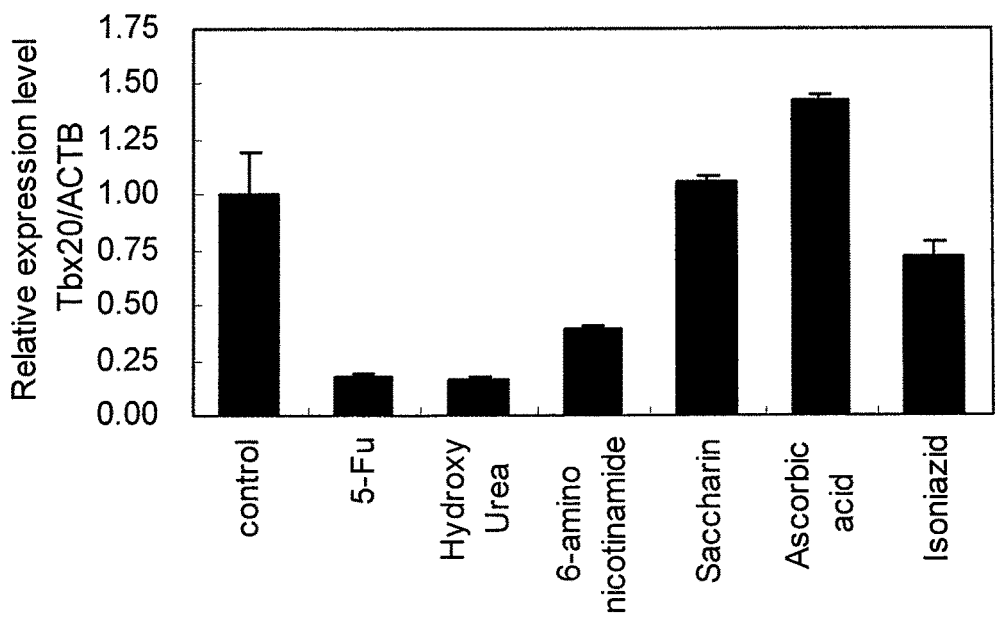
Figure 8:
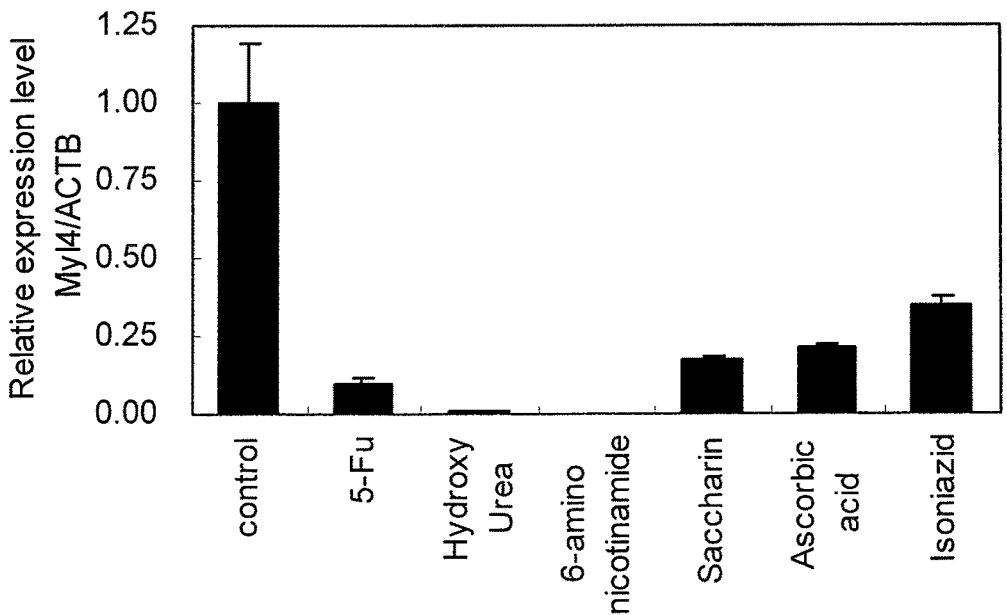
Figure 9:
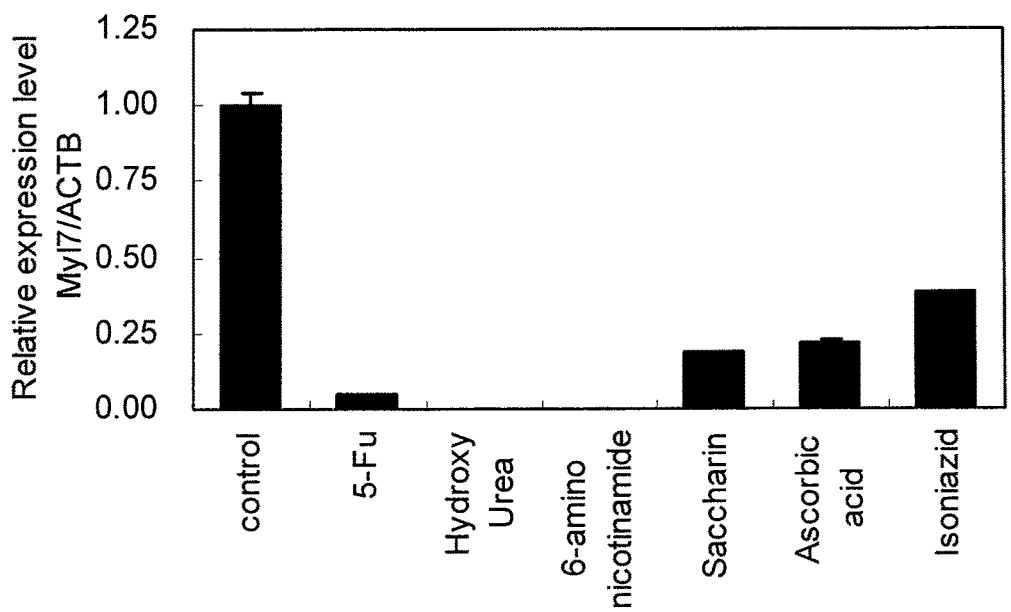
Figure 10:
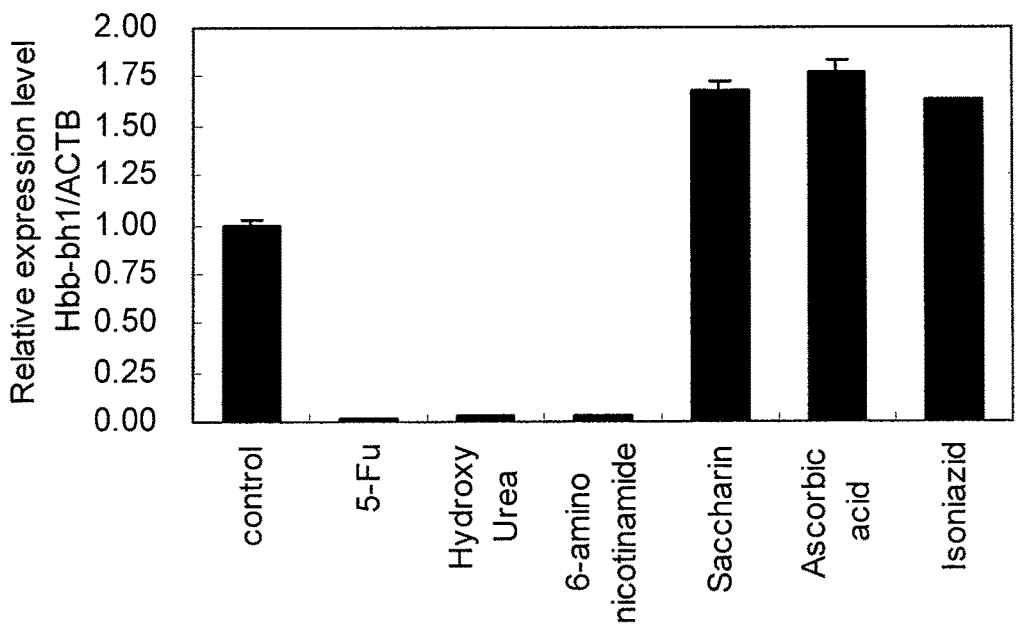
Figure 11:
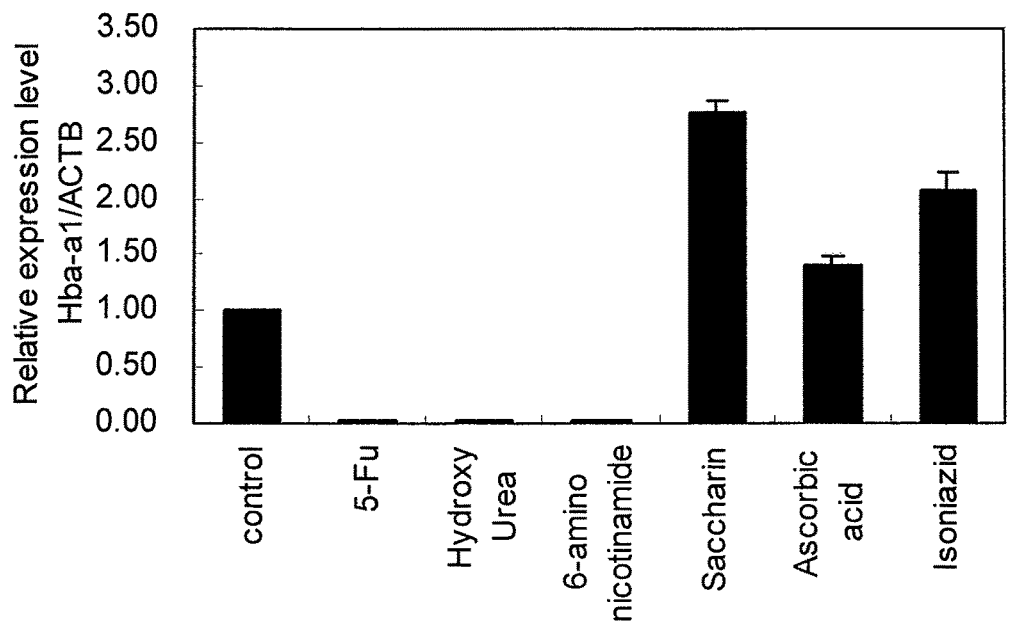
Figure 12:
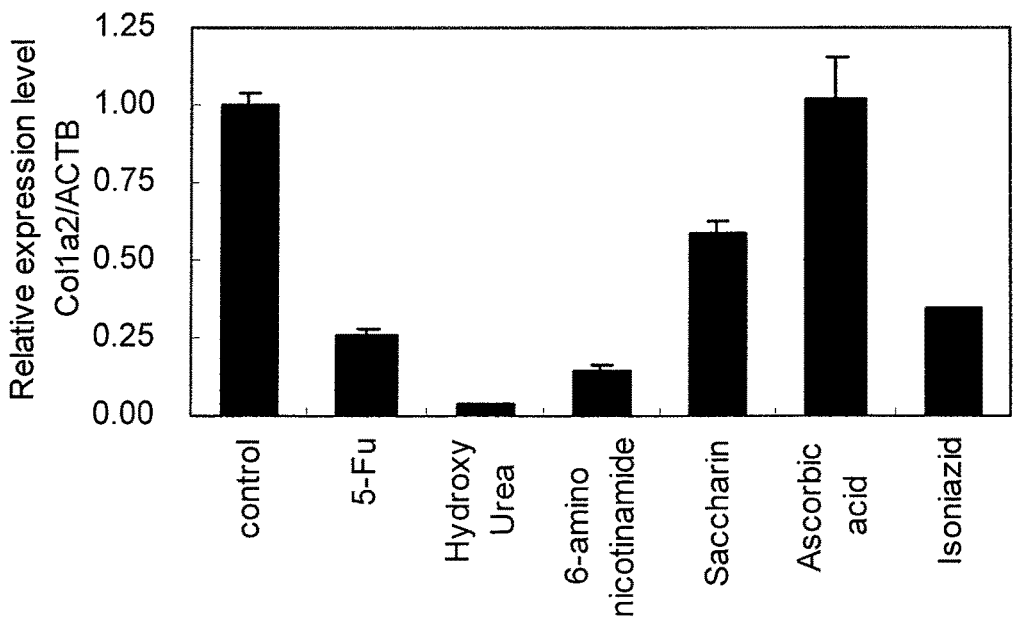
Figure 13:
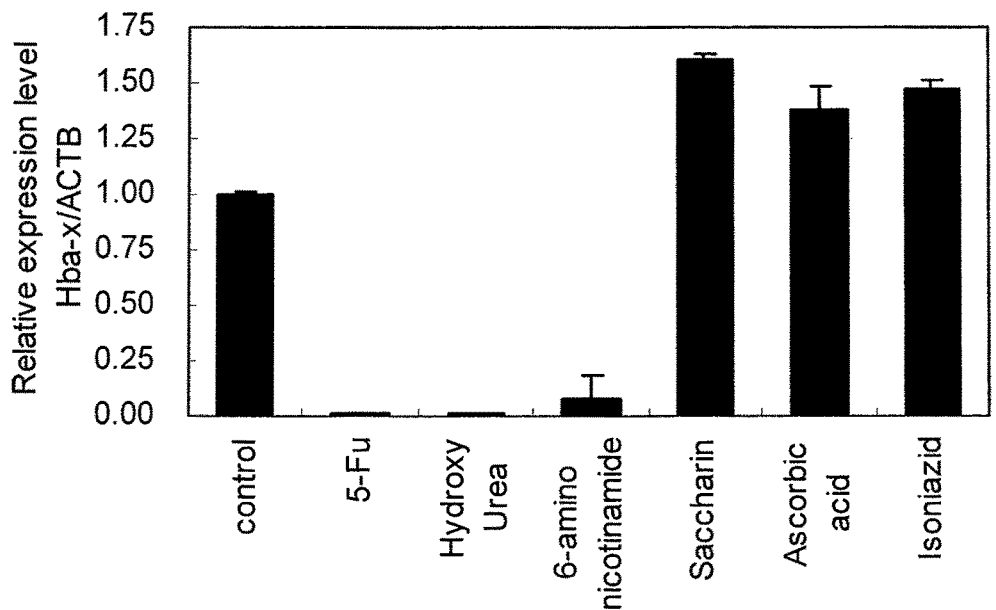

The RNA concentration was measured using a RiboGreen RNA quantification kit (Invitrogen), and RNA equivalent to 300 ng was reacted at 42° C. for 1 hour using oligo dT primer and reverse transcriptases of Superscript III RT (Invitrogen), to give cDNA at each day. 1 µL of the resulting cDNA, 1 µL of TaqMan probe, and 8 µL of TaqMan Fast Universal PCR Master Mix (Applied Biosystems) were mixed in a test tube for analysis and kept at 95° C. for 10 minutes. Thereafter, PCR was performed using a 7900HT Real-time PCR system under the reaction conditions repeating 40 cycles of a reaction of 95° C. for 10 seconds and 60° C. for 20 seconds. PCR was performed with 3 repetitions for each sample. As the TaqMan probe for each gene used for the analysis, Mm00433931_m1 for Hand1 gene, Mm00477337_m1 for ADAM19 gene, Mm00440826 ml for Pitx2 gene, Mm00495998_m1 for Cmya1 gene, Mm00477663_m1 for Smyd1 gene, Mm00454579_m1 for Pim2 gene, Mm00451515_m1 for Tbx20 gene, Mm00440378_m1 for Myl4 gene, Mm00491655 ml for Myl7 gene, Mm00433932_g1 for Hbb-bh1 gene, Mm00845395_s1 for Hba-a1 gene, Mm00483888_m1 for Col1a2 gene, and Mm00439255_m1 for Hba-x gene (all manufactured by Applied Biosystems) were used. In addition, using 1 µL of Pre-developed TaqMan Assay Reagents capable of analyzing mouse β actin gene and 1 µL of cDNA, PCR was performed in the same manner using a 7900HT Real-time PCR system, to obtain a data of the endogenous control. The expression level of the candidate gene on each day of the differentiation induction was divided by the expression level of mouse β actin gene on the same day, whereby the expression level of each marker gene was evaluated. The evaluation was done on the basis of the data on the day when the expression of each candidate gene was the highest. As a result, as shown in FIGS. 1 to 13, Hand1 gene, ADAM19 gene, Cmya1 gene, Pitx2 gene, Smyd1 gene, Pim2 gene, Tbx20 gene, Myl4 gene, Myl7 gene, Hbb-bh1 gene, Hba-a1 gene, Col1a2 gene, and Hba-x gene were strongly suppressed in the groups treated with embryotoxic chemicals as compared to the groups treated with non-embryotoxic chemicals and identified as marker genes.

Example 4

The process of verifying reliability of the marker genes identified in Example 3 for prediction of embryotoxicity using embryotoxic chemicals and non-embryotoxic chemicals other than the chemicals used in Example 3 will be described.
(Collection of Sample Contacted with Test Chemical on Induction of Myocardial Differentiation)

The ES-D3 cell line was cultured while maintaining an undifferentiated state in DMEM medium containing 15% heat inactivated fetal bovine serum supplemented with LIF in an incubator at 37° C. and 5% $CO_2$. In the differentiation induction method, first, the cells were dispersed using 0.25% trypsin/1 mM EDTA, and thereafter, using a medium containing 15% heat inactivated fetal bovine serum not containing LIF, the cells were cultured for 3 days by hanging drop culture in a petri dish with a diameter of 10 cm, so as to contain about 750 cells per droplet. The formed embryoid bodies were further cultured in suspension in a nonadherent 6 cm petri dish (greiner) for 2 days, and thereafter, the embryoid bodies were seeded in a 24-well plate (BD Falcon). The series of differentiation induction described above was performed in a medium supplemented with a solvent control group, groups treated with embryotoxic chemical (1.5 µg/mL 5-bromo-2'-deoxyuridine, 0.6 µg/mL methotrexate, or 0.001 µg/mL all-trans-retinoic acid), and groups treated with non-embryotoxic chemical (1500 µg/mL penicillin G sodium salt, 25 µg/mL acrylamide, or 100 µg/mL D-(+)-camphor). 10 days of culture was performed replacing with a medium supplemented with a compound prepared again at day 3 and day 5 from the start of the hanging drop. On each day at day 1, day 2, day 3, day 4, day 5, day 6, day 7, day 8, day 9, and day 10 from the start of the hanging drop, 50 or more cells were collected, mixed, and defined as 1 group, and more than 4 groups of the cells were collected. The collected cells were dissolved in 100 µl of Trisol solution (Invitrogen) and stored at −80° C. RNA was extracted from a stored sample according to the conventional method and then purified with an RNeasy mini kit (QIAGEN).
(Expression Analysis of Marker Gene by Qualitative PCR)

The RNA concentration was measured using a RiboGreen RNA quantification kit (Invitrogen), and RNA equivalent to 300 ng was reacted at 42° C. for 1 hour using oligo dT primer and reverse transcriptases of Superscript III RT (Invitrogen), to give cDNA at each day. 1 µL of the resulting cDNA, 1 µL of TaqMan probe, and 8 µL of TaqMan Fast Universal PCR Master Mix (Applied Biosystems) were mixed in a test tube for analysis and kept at 95° C. for 10 minutes. Thereafter, PCR was performed using a 7900HT Real-time PCR system under the reaction conditions repeating 40 cycles of a reaction of 95° C. for 10 seconds and 60° C. for 20 seconds. PCR was performed with 3 repetitions for each sample. As the TaqMan probe for each gene, Mm00433931_m1 for Hand1 gene, Mm00477337_m1 for ADAM19 gene, Mm00440826_m1 for Pitx2 gene, Mm00495998_m1 for Cmya1 gene, Mm00477663_m1 for Smyd1 gene, Mm00454579_m1 for Pim2 gene, Mm00451515_m1 for Tbx20 gene, Mm00440378_m1 for Myl4 gene, Mm00491655_m1 for Myl7 gene, Mm00433932_g1 for Hbb-bh1 gene, Mm00845395_s1 for Hba-a1 gene, Mm00483888_m1 for Col1a2 gene, and Mm00439255_m1 for Hba-x gene (all manufactured by Applied Biosystems) were used for the analysis.

Figure 14:
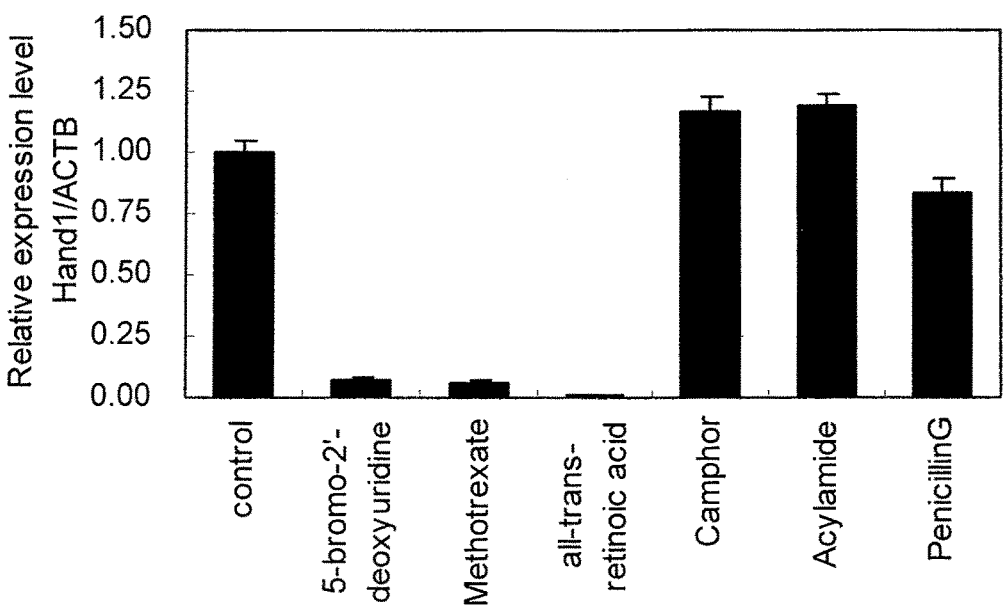
FIGS. 14 to 26 are drawings showing expression levels of marker genes for assessing embryotoxicity as relative expression levels, the expression levels being quantitated by using real-time PCR method for a solvent control group, groups treated with embryotoxic chemicals (5-bromo-2'-deoxyuridine, methotrexate and all-trans-retinoic acid) and groups treated with non-embryotoxic chemicals (penicillin G sodium salt, acrylamide and D-(+)-camphor).
Figure 15:
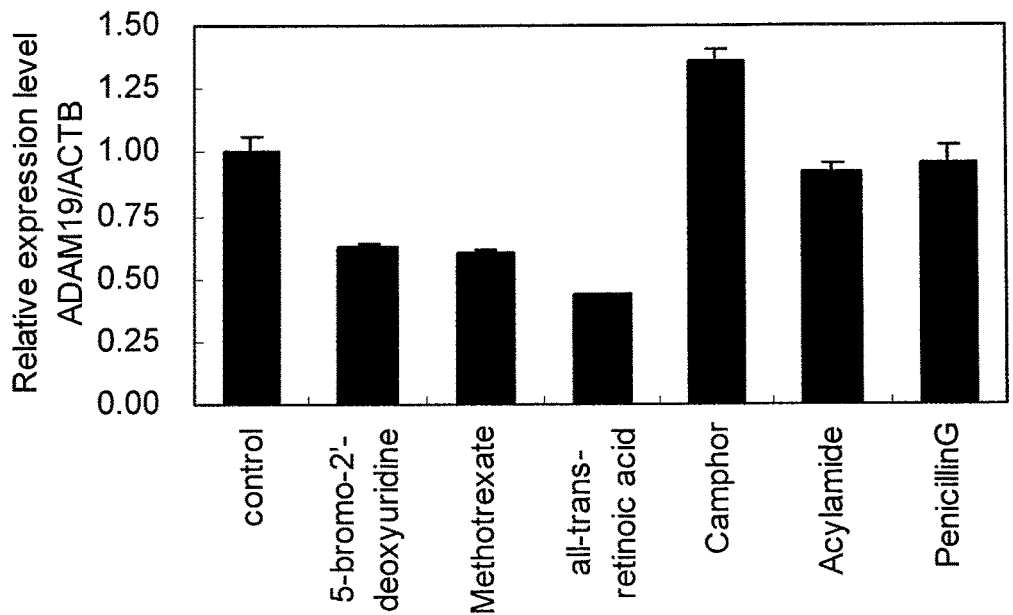
Figure 16:
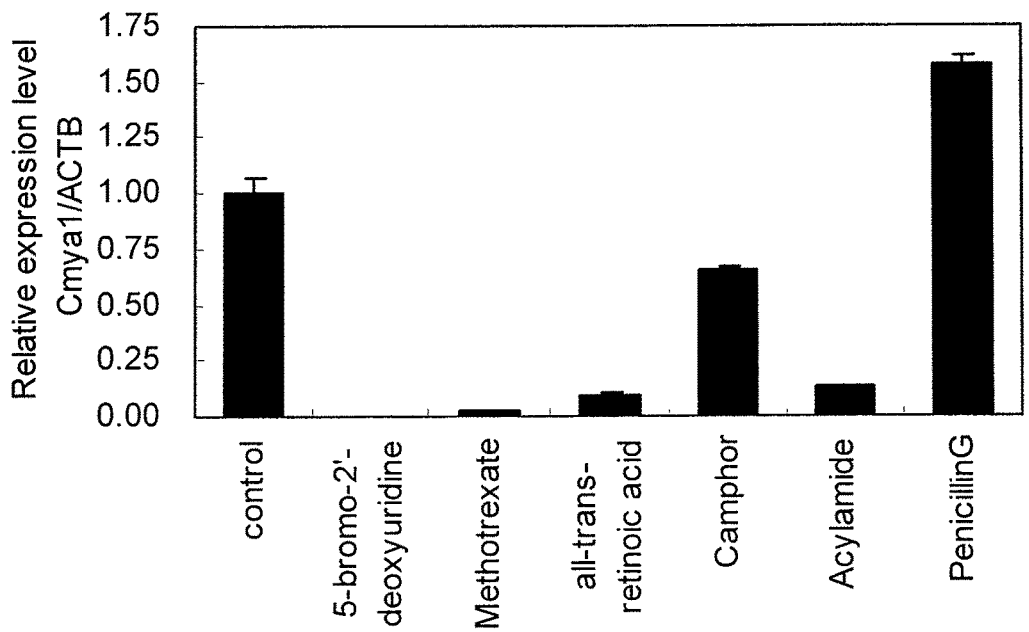
Figure 17:
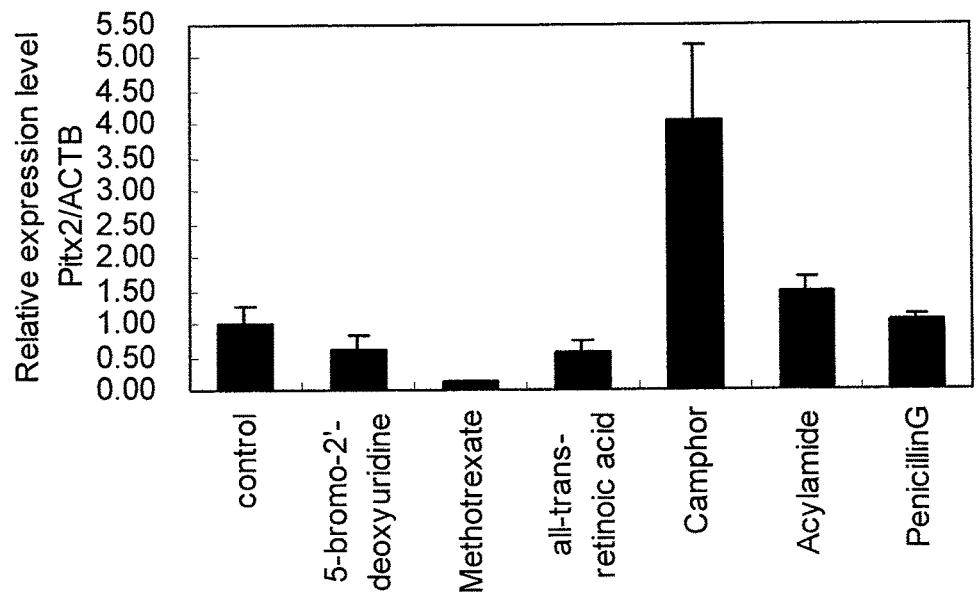
Figure 18:
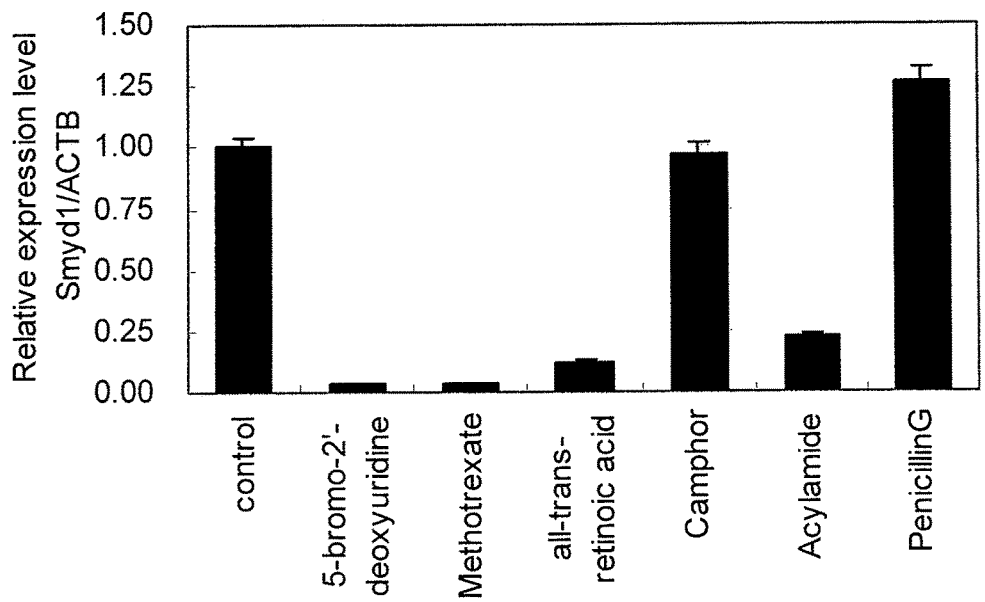
Figure 19:
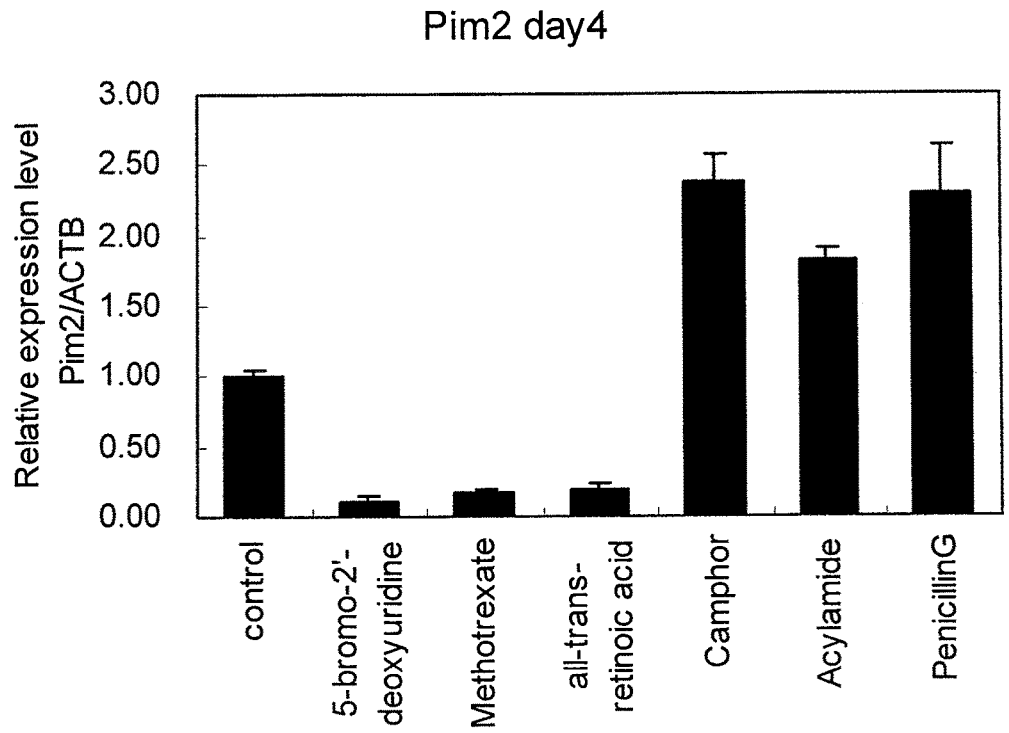
Figure 20:
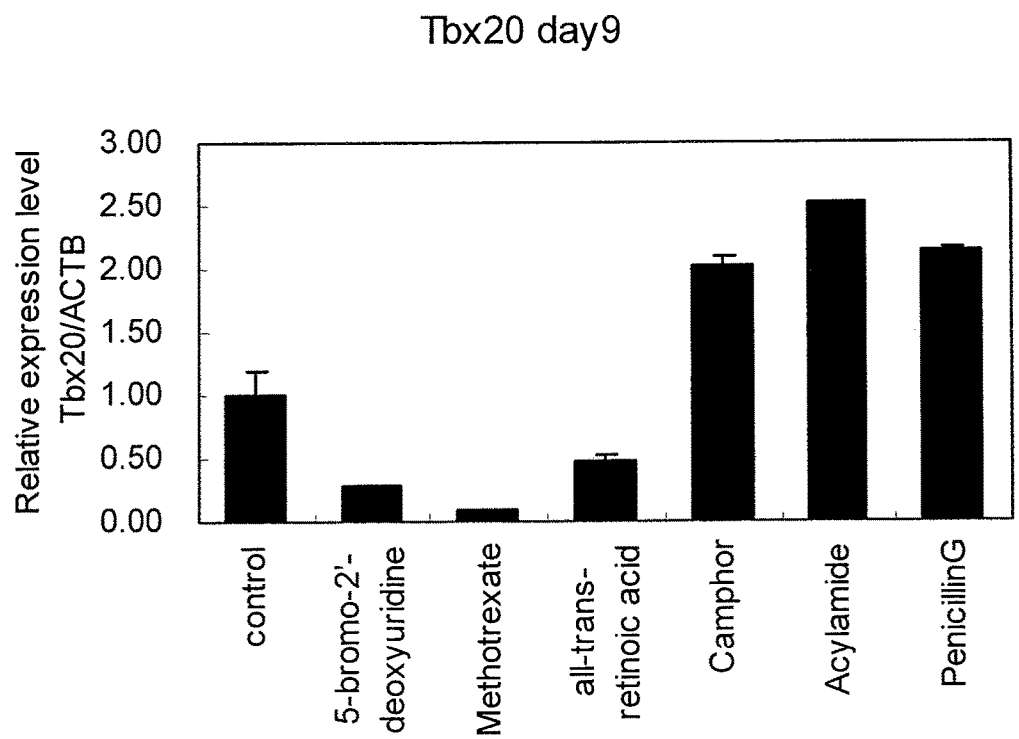
Figure 21:
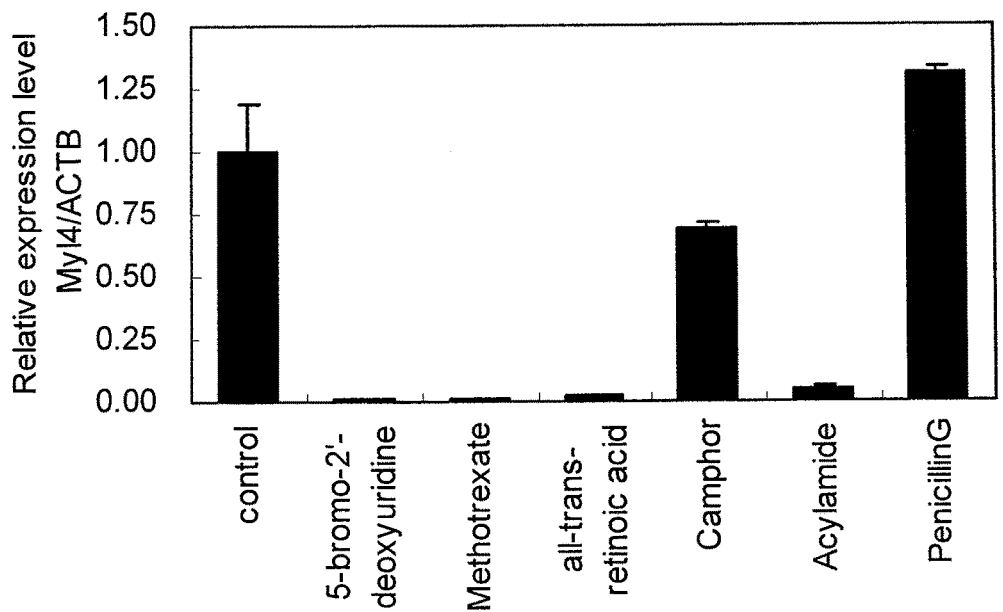
Figure 22:
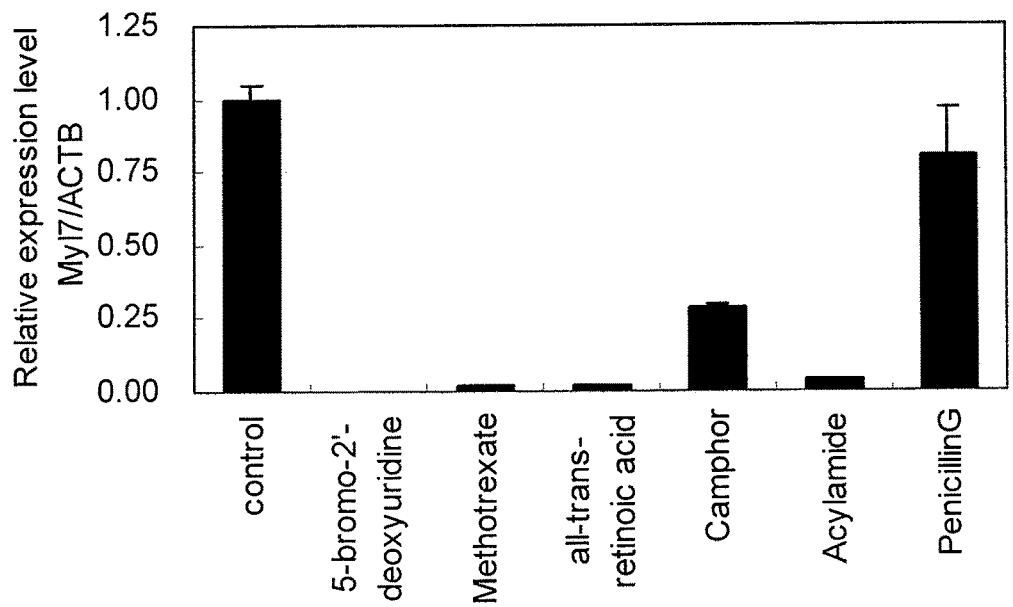
Figure 23:
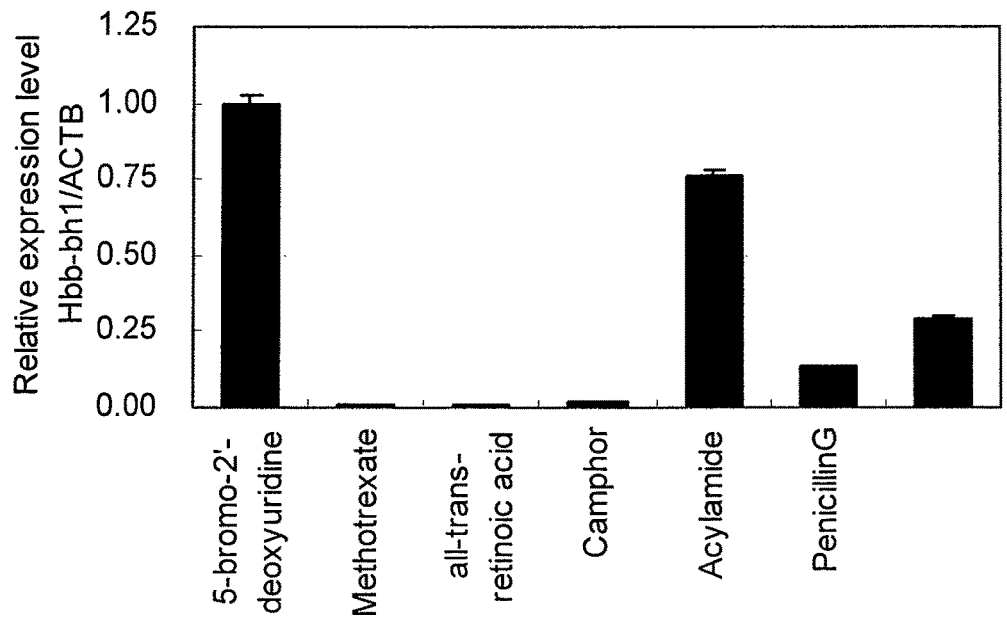
Figure 24:
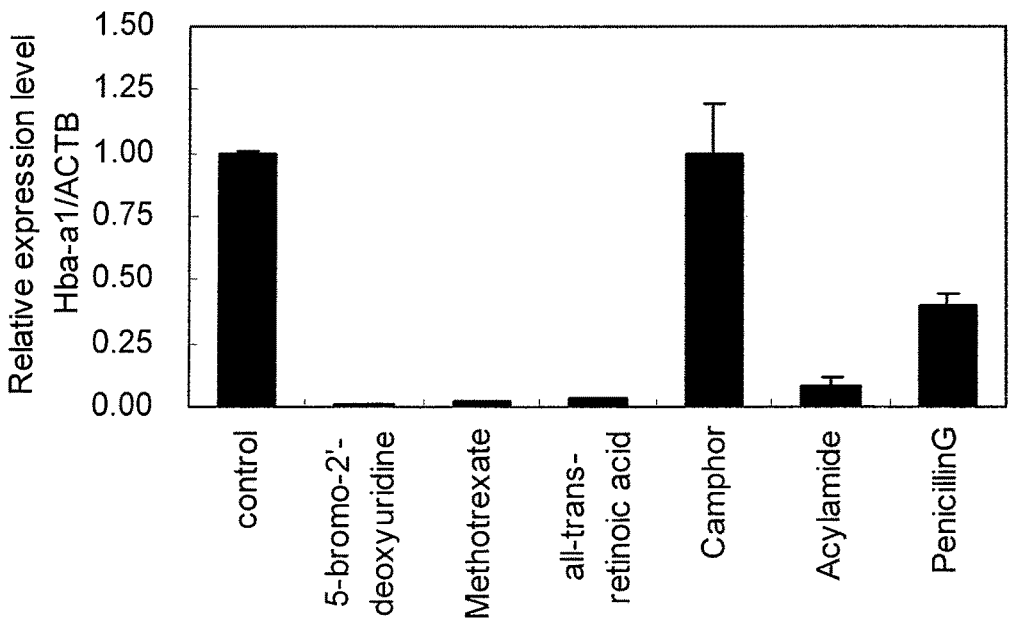
Figure 25:
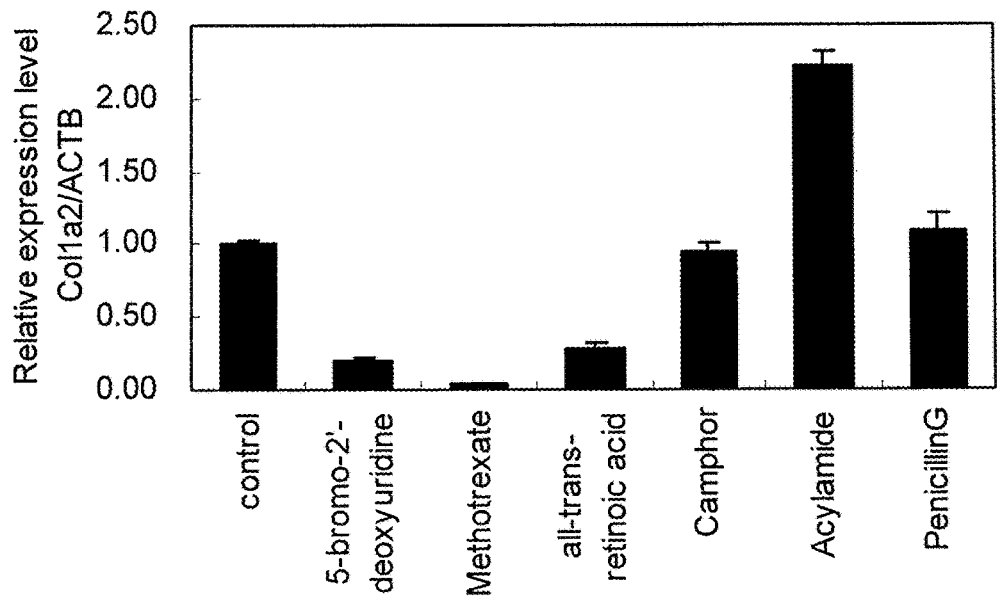
Figure 26:
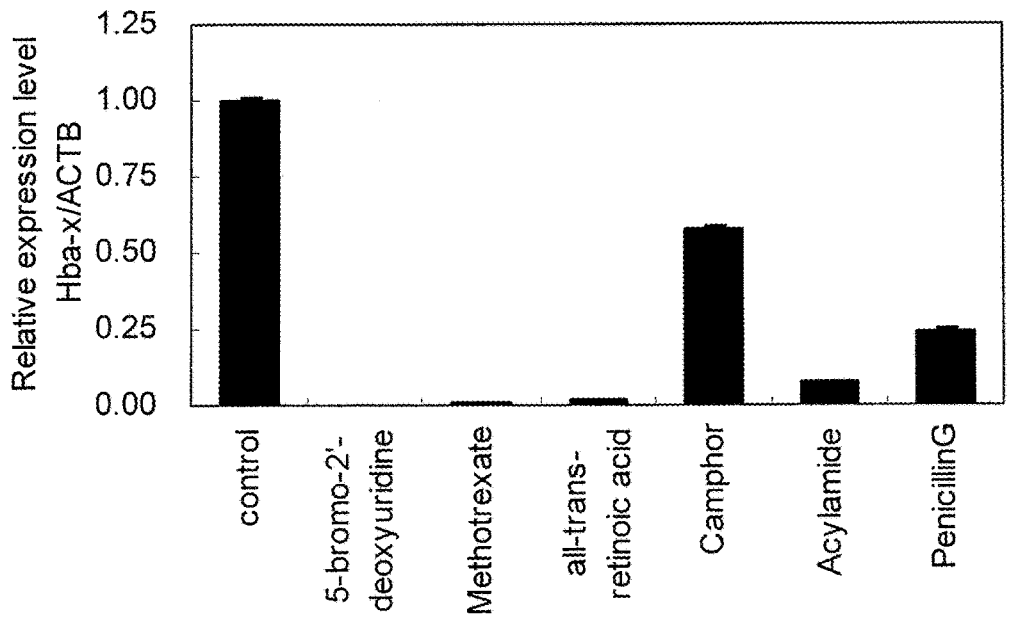

In addition, using 1 µL of Pre-developed TaqMan Assay Reagents capable of analyzing mouse β actin gene and 1 µL of cDNA, PCR was performed in the same manner using a 7900HT Real-time PCR system, to obtain a data of the endogenous control. In the data obtained by the analysis, the expression level of the marker gene on each day of the differentiation induction was divided by the expression level of mouse β actin gene on the same day, whereby the expression level of each marker gene was evaluated. The measurement date was determined as the day when the expression of each marker gene was the highest. As a result, as shown in FIGS. 14 to 26, Hand1 gene, ADAM19 gene, Cmya1 gene, Pitx2 gene, Smyd1 gene, Pim2 gene, Tbx20 gene, Myl4 gene, Myl7 gene, Hbb-bh1 gene, Hba-a1 gene, Col1a2 gene, and Hba-x gene tended to be strongly suppressed in the groups treated with embryotoxic chemicals as compared to the groups treated with non-embryotoxic chemicals and verified as marker genes.

Example 5

Hereinbelow, a method for preparing ES cells transformed with a vector containing a reporter gene under the control of promoter expression of a marker gene will be described.
(Cloning of Promoter of Marker Gene and Preparation of Reporter Plasmid)

A promoter region of each marker gene in the present invention was cloned by PCR using the primers as shown below.

When 5 kb of the promoter region of Hand1 gene was amplified, the primer depicted in SEQ ID NO: 79 and the primer depicted in SEQ ID NO: 82 were used; when 2 kb of the promoter region was amplified, the primer depicted in SEQ ID NO: 80 and the primer depicted in SEQ ID NO: 82 were used; and 1 kb of the promoter region was amplified, the primer depicted in SEQ ID NO: 81 and the primer depicted in SEQ ID NO: 82 were used. 20 ng of genomic DNA extracted from ES-D3 cells and the each primer prepared as 10 µM were amplified by PCR method using Platinum Taq polymerase (Invitrogen). PCR reaction was performed with a GeneAmp PCR System 9700 (Applied Biosystems), using the reaction conditions of 95° C. for 5 minutes, followed by 30 cycles of 95° C. for 30 seconds, 55° C. for 30 seconds, and 72° C. for 1 minute, and 72° C. for 7 minutes.

When 5 kb of the promoter region of Smyd1 gene was amplified, the primer depicted in SEQ ID NO: 83 and the primer depicted in SEQ ID NO: 86 were used; when 2 kb of the promoter region was amplified, the primer depicted in SEQ ID NO: 84 and the primer depicted in SEQ ID NO: 86 were used; and when 1 kb of the promoter region was amplified, the primer depicted in SEQ ID NO: 85 and the primer depicted in SEQ ID NO: 86 were used.

When 5 kb of the promoter region of Pitx2 gene was amplified, the primer depicted in SEQ ID NO: 87 and the primer depicted in SEQ ID NO: 90 were used; when 2 kb of the promoter region was amplified, the primer depicted in SEQ ID NO: 88 and the primer depicted in SEQ ID NO: 90 were used; and when 1 kb of the promoter region was amplified, the primer depicted in SEQ ID NO: 89 and the primer depicted in SEQ ID NO: 90 were used.

When 5 kb of the promoter region of Cmya1 gene was amplified, the primer depicted in SEQ ID NO: 91 and the primer depicted in SEQ ID NO: 94 were used; when 2 kb of the promoter region was amplified, the primer depicted in SEQ ID NO: 92 and the primer depicted in SEQ ID NO: 94 were used; and when 1 kb of the promoter region was amplified, the primer depicted in SEQ ID NO: 93 and the primer depicted in SEQ ID NO: 94 were used.

When 5 kb of the promoter region of Pim2 gene was amplified, the primer depicted in SEQ ID NO: 95 and the primer depicted in SEQ ID NO: 98 were used; when 2 kb of the promoter region was amplified, the primer depicted in SEQ ID NO: 96 and the primer depicted in SEQ ID NO: 98 were used; and when 1 kb of the promoter region was amplified, the primer depicted in SEQ ID NO: 97 and the primer depicted in SEQ ID NO: 98 were used.

When 5 kb of the promoter region of ADAM19 gene was amplified, the primer depicted in SEQ ID NO: 99 and the primer depicted in SEQ ID NO: 100 were used.

Each PCR product of Cmya1 gene was digested with Hind III (TAKARA BIO INC.), and each PCR product of Hand1, ADAM19, Smyd1, Pitx2, and Pim2 genes was digested with Kpn I (TAKARA BIO INC.), and then electrophoresed and purified from the gel. The purified DNA fragments were each digested with Hind III or Kpn I and linked using pGL4.17[Luc2/Neo]vector (Promega) dephosphorylated with Alkaline phosphatase (TAKARA BIO INC.) and Ligation kit (TAKARA BIO INC.), then transformed into DH5α competent cells (TAKARA BIO INC.) and cultured overnight in LB/ampicillin medium at 37° C. The appeared colonies were cultured in LB/ampicillin liquid medium, and plasmid DNA was extracted from the proliferated E. coli. The sequence of an insert fragment of the obtained plasmid DNA was determined, and the presence or absence of mutation or the like was confirmed.

In order to use for transfection into ES cells, each plasmid was extracted again with an Qiafilter plasmid extraction kit (QIAGEN). 20 µg of the resulting plasmid DNA was treated with restriction enzyme by Sal I for the promoters of Cmya1, Hand1, Pim2, ADAM19, and Pitx2 and by Not I for Smyd1, and then purified to obtain linearized DNA.

(Method for Preparing Recombinant ES Cells)

The ES-D3 cells cultured while maintaining an undifferentiated state were dispersed using 0.25% trypsin/1 mM EDTA, and thereafter, $0.3 \times 10^5$ cells were seeded in a 0.1% gelatin-coated 35 mm petri dish and cultured in DMEM medium containing 15% heat inactivated fetal bovine serum supplemented with LIF. Thereafter, Opti-MEM medium, 4 µg of the linearized DNA, and 12 µL of Lipofectamine 2000 (Invitrogen) were mixed and allowed to react at room temperature for 30 minutes, and then the total amount was added to the cell culture.

After culturing in an incubator at 37° C. and 5% $CO_2$ for 1 hour, the medium was replaced with DMEM medium containing 15% heat inactivated fetal bovine serum supplemented with LIF. After 12 hours, each cell was dispersed using 0.25% trypsin/1 mM EDTA and then seeded in a 0.1% gelatin-coated 10 cm petri dish using DMEM medium containing 15% heat inactivated fetal bovine serum supplemented with LIF containing 100 µg/mL G418 (Invitrogen), and drug selection culture was started. After 7 days to 10 days, the ES cell colonies formed in the petri dish were isolated under a stereomicroscope and seeded in a 96-well plate, and drug selection culture was continued. With replacing the medium every 3 days, the proliferated cells were subcultured after 7 days to 10 days and seeded in a 48-well plate, and drug selection culture was continued, to obtain a drug-resistant stably-transformed cell line.

(Method for Selecting Cell Line)

Figure 27:
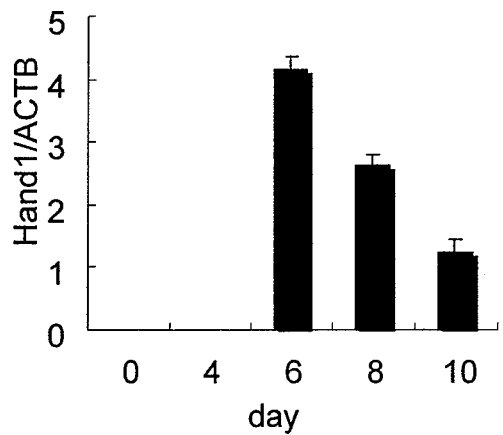
FIG. 27 is a drawing showing the result of serial measurement by using real-time PCR method of the expression level of endogenous Hand1 gene after induction of differentiation.
Figure 28:
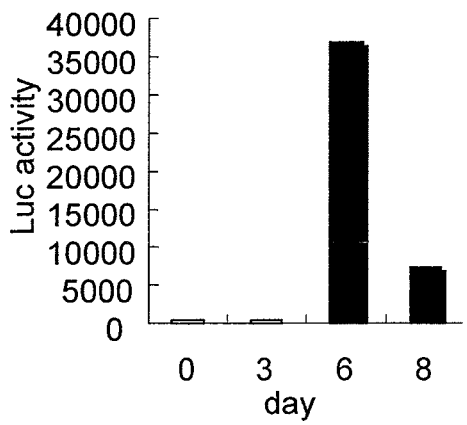
FIG. 28 is a drawing showing the result of serial measurement of the luciferase activity of Hand1-ES cells after induction of differentiation.
Figure 29:
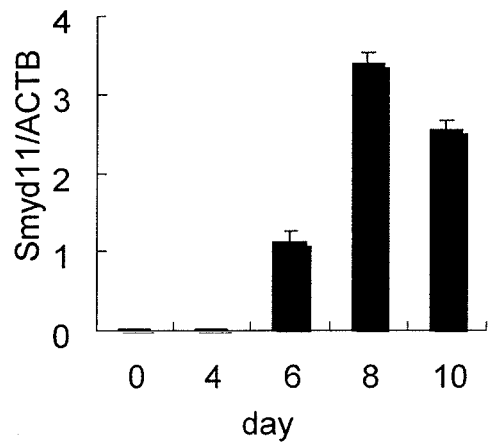
FIG. 29 is a drawing showing the result of serial measurement by using real-time PCR method of the expression level of endogenous Smyd1 gene after induction of differentiation.
Figure 30:
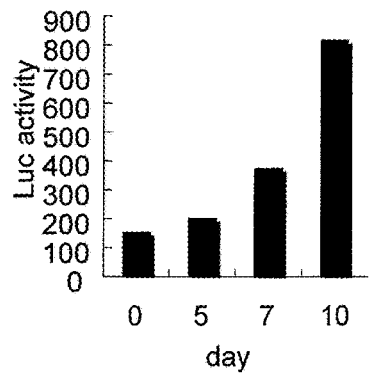
FIG. 30 is a drawing showing the result of serial measurement of the luciferase activity of Smyd1-ES cells after induction of differentiation.

The obtained cell line was cultured while maintaining an undifferentiated state in DMEM medium containing 15% heat inactivated fetal bovine serum supplemented with LIF containing 100 µg/mL G418 and was dispersed using 0.25% trypsin/1 mM EDTA. The medium was replaced with DMEM medium containing 15% heat inactivated fetal bovine serum not supplemented with LIF, and thereafter, hanging culture was performed for 3 days in a volume of 750 cells/20 µL, followed by suspension culture for 2 days and adhesion culture for 5 days, whereby induction of differentiation into cardiac muscle was performed. For each of the cell lines, 50 or more embryoid bodies were collected every 2 days for 10 days and defined as 1 sample, and RNA extraction was carried out according to the conventional method. The extracted RNA was thereafter purified with an RNaeasy mini kit (QIAGEN). The RNA concentration was measured using a RiboGreen RNA quantification kit (Invitrogen), and thereafter, RNA equivalent to 1 µg was reacted at 42° C. for 1 hour using oligo dT primer and reverse transcriptases of Superscript III RT (Invitrogen), to synthesize cDNA. For samples at day 0, day 2, day 4, day 6, day 8, and day 10 of each of the cell lines, PCR was performed using a primer pair capable of amplifying Luc2 gene (5'-agtagtggcagtaccggat-3' (SEQ ID NO: 239) and 5'-ctcgtg-caagttgcttagg-3' (SEQ ID NO: 240)) and ExTaq polymerase (TAKARA BIO INC.), and thereafter, gel electrophoresis of the PCR product was performed. Also, the expression levels of each marker gene and β actin gene were compared, and a cell line that induces the expression of Luc2 gene with differentiation induction was selected. Furthermore, measurement of the luciferase activity of the selected cell line after differentiation induction was performed as follows. First, the cell line was cultured while maintaining an undifferentiated state in DMEM medium containing 15% heat inactivated fetal bovine serum supplemented with LIF containing 100 µg/mL G418 and was dispersed using 0.25% trypsin/1 mM EDTA. The medium was replaced with DMEM medium containing 15% heat inactivated fetal bovine serum not supplemented with LIF, and thereafter, induction of myocardial differentiation was started by the hanging drop method in a volume of 750 cells/20 µL, and the suspension culture was performed for 3 days. After 3 days, 100 µL of DMEM medium containing 15% heat inactivated fetal bovine serum not supplemented with LIF was added, and the suspension culture was continued for 2 days. Thereafter, on day 5, the formed embryoid bodies were transferred to a 96-well plate for adhesion culture (Corning Incorporated), and the adhesion culture was started. On each day from day 6 to day 10 from the start of differentiation induction, 50 µL of a luciferase luminescent reagent, Steady-Glo, was added to each well of four 96-well plates from which culture solution was removed by suction. After shaking for 10 minutes, the luciferase activity was measured with a TopCount NXT luminescence detection counter (Packard Japan). For example, for ES cells transformed with a vector containing a reporter gene under the control of promoter expression of hand1 gene (hereinafter, referred to as Hand1-ES cells) and ES cells transformed with a vector containing a reporter gene under the control of promoter expression of smyd1 gene (hereinafter, referred to as smyd1-ES cells), endogenous expression level of hand1 gene or msyd1 gene and the results of sequential measurement of the luciferase activity are shown in FIGS. 27 to 30. It was revealed that Hand1-ES cells and smyd1-ES cells agree in the patterns of endogenous gene expression and induction of the luciferase activity.

Example 6

Hereinbelow, a method for assessing embryotoxicity during myocardial differentiation using the selected recombinant ES cells will be described.

The obtained recombinant ES cell line is cultured while maintaining an undifferentiated state in DMEM medium containing 15% heat inactivated fetal bovine serum supplemented with LIF containing 100 μg/mL G418. The undifferentiated colonies are dispersed using 0.25% trypsin/1 mM EDTA, and thereafter, the cells are suspended in DMEM medium containing 15% heat inactivated fetal bovine serum supplemented with LIF. Residual trypsin is removed by centrifugation and suction of the supernatant, and the cells are suspended in DMEM medium containing 15% heat inactivated fetal bovine serum not containing LIF. Thereafter, the number of cells is counted using a small amount of the cell solution. A differentiation medium supplemented with only PBS(−) as a solvent control group, a differentiation medium supplemented with a hydroxyurea solution (dissolved in PBS(−)) so as to be a final concentration of 4.0 μg/mL as a positive control (positive compound and concentration such that the differentiation into cardiac muscle is suppressed) group, and a differentiation medium prepared by diluting a test chemical to five levels with a common ratio of 10 are prepared. Thereafter, a cell suspension is prepared so as to have a cell number of $3.75 \times 10^4$ cells per 1 mL in each differentiation medium, induction of myocardial differentiation is started by the hanging drop method in a volume of 750 cells/20 μl, and the culture is performed for 3 days. On day 3, 100 μl of the differentiation medium again prepared and the differentiation medium supplemented with the test chemical are added, and the suspension culture is continued for 2 days. On day 5, the formed embryoid bodies are transferred to a 96-well plate for adhesion culture (Corning Incorporated) to which the differentiation medium again prepared and the differentiation medium supplemented with the test chemical have been previously dispensed, and the adhesion culture is started. On each day from day 6 to day 10 from the start of differentiation induction, 50 μL of a luciferase luminescent reagent, Steady-Glo, is added to each well of four 96-well plates from which culture solution is removed by suction. After shaking for 10 minutes, the luciferase activity is measured with a TopCount NXT luminescence detection counter (Packard Japan). The obtained activity values are averaged and tallied for the solvent control group, the positive control group and every concentration of the test chemical. The obtained activity values are averaged and tallied for the solvent control group, the positive control group and every concentration of the test chemical. Using these methods, the amounts of change in the luciferase activities of the solvent control group, the positive control group and the test chemical are compared, and the concentration of the test chemical that inhibits myocardial differentiation can be determined.

Example 7

Induction of ES Cell Differentiation into Nerve

According to the processes described in Examples 1 to 5, embryotoxicity of a test chemical to cardiac tissue could be assessed by identifying a marker that assesses the embryotoxicity to cardiac tissue and using a nucleic acid construct of a marker gene and a transformed cell. When the method for inducing differentiation from ES cells to brain and nerve as shown below is applied, the method for assessing the embryotoxicity to brain and nerve is feasible as well as cardiac tissue. The method for inducing ES cell differentiation to neural cells is shown hereinafter.

The ES-D3 cells were cultured while maintaining an undifferentiated state in DMEM medium containing 15% heat inactivated fetal bovine serum supplemented with LIF in an incubator at 37° C. and 5% $CO_2$. The cells were dispersed using 0.25% trypsin/1 mM EDTA, and then the cells were suspended in DMEM medium containing 15% heat inactivated fetal bovine serum supplemented with LIF. Thereafter, residual trypsin and serum were removed by centrifugation and suction of the supernatant, and the cells were suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells was counted using a small amount of the cell solution, and thereafter, 10 mL of the cells were seeded in a 10 cm nonadherent petri dish at a cell density of $5 \times 10^5$ cells/mL and cultured in an incubator at 37° C. and 5% $CO_2$ or an incubator at 37° C., 5% $CO_2$, and 5% $O_2$. On day 3 from the start of differentiation, 10 mL of neural differentiation medium was added, and the suspension culture was continued for 2 days. On day 5 from the start of differentiation, all cells and culture solution were transferred to a centrifuging tube and allowed to stand at room temperature for 10 minutes, to precipitate embryoid bodies. The supernatant was gently removed, and then the embryoid bodies were suspended in neural differentiation medium and transferred to a 6 cm petri dish. The embryoid bodies in the 6 cm petri dish were seeded in each well of a Poly-D-Lysine/Laminine-coated 24-well plate treated with fibronectin/PBS (−) solution prepared as 5 μg/mL, so as to have 10 to 20 embryoid bodies per well, using a stereomicroscope. The culture was continued for further 5 days in an incubator at 37° C. and 5% $CO_2$ or an incubator at 37° C., 5% $CO_2$, and 5% $O_2$. On day 10 from the start of differentiation, a neurite was observed under a phase-contrast microscope for some wells. Further, immunostaining was performed using an antibody to representative marker gene of neural differentiation, MAP2, and the presence or absence of a MAP2-positive cell was confirmed.

Example 8

Induction of ES Cell Differentiation into Osteoblasts

The ES-D3 cells were cultured while maintaining an undifferentiated state in DMEM medium containing 15% heat inactivated fetal bovine serum supplemented with LIF in an incubator at 37° C. and 5% $CO_2$. The cells were dispersed using 0.25% trypsin/1 mM EDTA, and then the cells were suspended in DMEM medium containing 15% heat inactivated fetal bovine serum, and residual trypsin and serum were removed by centrifugation and suction of the supernatant. Thereafter, the cells were suspended again in DMEM medium containing 15% heat inactivated fetal bovine serum, and the number of cells was counted using a small amount of the cell solution. After counting, 2 mL of the cell suspension prepared so as to have a concentration of $1.0 \times 10^4$ cells/mL was added to a 0.1% gelatin-coated 35 mm dish, and the culture was started in an incubator at 37° C. and 5% $CO_2$. On day 4 from the start of culture, the dish was washed with PBS, and the medium was replaced with DMEM medium containing 15% heat inactivated fetal bovine serum supplemented with 50 μg/ml ascorbic acid and β-glycerophosphoric acid at a concentration of 10 mM. Thereafter, the medium was replaced with a medium with the same composition every 2 to 3 days. The samples were collected on day 4, 10, 15 and 20 from the start of culture, and calcium deposition was detected by alizarin staining from some samples. On the other hand, after extracting Total RNA, for the genes specific to osteoblasts (Runx2, Osteoprotegerin, Osteopontin, and Collagen1a1), the relative expression levels were compared using ACTB as an internal standard, whereby the expression of specific gene could be confirmed.

Example 9

Analysis of Global Changes in Expression During Neural Differentiation

RNA was extracted from a total of 24 samples, at a total of 6 time points at day 0, day 2, day 4, day 6, day 8, and day 10 after differentiation induction (4 groups per day) using an RNeasy RNA extraction kit (QIAGEN) according to the method of Example 7. The concentration measurement with a RiboGreen RNA quantification kit (Invitrogen) and the quality confirmation of RNA degradation by electrophoresis were carried out for all the extracted RNA. Using RNA prepared as 4 μg based on the result of the concentration measurement, gene expression alteration profile data was exhaustively collected using a GeneChip Mouse Genome 430 2.0 Array (Affymetrix) and analyzed. As a specific analysis method, genes expression of which commonly alters in all groups at each time point were first extracted using Bioinformatics analysis software. Subsequently, expression pattern classification was sequentially performed to group the extracted genes. Basp1 gene, Cpe gene, DDR1 gene, Marcks gene, NDN gene, Nnat gene, Ptbp2 gene, Sfrp2 gene, Sox11 gene, Ttc3 gene, Tubb2b gene, Ubqln2 gene, Vim gene, Six3 gene, Arx gene, Dcx gene, L1cam gene, Emx2 gene, Wnt1 gene, Reln gene, and Pax6 gene that showed expression alteration at each day (day 2, day 4, day 6, day 8, and day 10) against day 0 were extracted as candidate genes.

Example 10

A method for analyzing alteration in the expression level of the candidate gene by quantitative PCR using embryotoxic and non-embryotoxic chemicals, to identify a marker gene will be described.
(Collection of Sample Contacted with Test Chemical on Induction of Neural Differentiation)

The ES-D3 cells were cultured while maintaining an undifferentiated state in DMEM medium containing 15% heat inactivated fetal bovine serum supplemented with LIF in an incubator at 37° C. and 5% $CO_2$. The cells were dispersed using 0.25% trypsin/1 mM EDTA, and then the cells were suspended in DMEM medium containing 15% heat inactivated fetal bovine serum supplemented with LIF. Thereafter, residual trypsin and serum were removed by centrifugation and suction of the supernatant, and the cells were suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells was counted using a small amount of the cell solution, and thereafter, 10 mL of the cells were seeded in a 10 cm nonadherent petri dish at a cell density of $5\times10^5$ cells/mL and cultured in an incubator at 37° C. and 5% $CO_2$ or an incubator at 37° C., 5% $CO_2$, and 5% $O_2$. On day 3 from the start of differentiation, 10 mL of neural differentiation medium was added, and the suspension culture was continued for 2 days. On day 5 from the start of differentiation, all cells and culture solution were transferred to a centrifuging tube and allowed to stand at room temperature for 10 minutes, to precipitate embryoid bodies. The supernatant was gently removed, and then the embryoid bodies were suspended in neural differentiation medium and transferred to a 6 cm petri dish. The embryoid bodies in the 6 cm petri dish were seeded in each well of a Poly-D-Lysine/Laminine-coated 24-well plate treated with fibronectin/PBS (−) solution prepared as 5 μg/mL, so as to have 10 to 20 embryoid bodies per well, using a stereomicroscope. The culture was continued for further 5 days in an incubator at 37° C. and 5% $CO_2$ or an incubator at 37° C., 5% $CO_2$, and 5% $O_2$. The series of differentiation induction described above was performed in a medium supplemented with a solvent control group, groups treated with an embryotoxic chemical (0.03 μg/mL 5-Fluorouracil, 4.0 μg/mL hydroxyurea, or 0.2 μg/mL methotrexate), and groups treated with a non-embryotoxic chemical (4,000 μg/mL saccharin sodium hydrate, 20 μg/mL ascorbic acid, 150 μg/mL isoniazide, 600 μg/mL penicillin G sodium salt, 50 μg/mL acrylamide, or 100 μg/mL D-(+)-camphor). 10 days of culture was performed replacing with a medium supplemented with a compound prepared again on day 3 and day 5 from the start of differentiation induction. On each day at day 1, day 2, day 3, day 4, day 5, day 6, day 7, day 8, day 9, and day 10 from the start of differentiation induction, 50 or more cells were mixed and defined as 1 group, and more than 4 groups of the cells were collected. The collected cells were dissolved in 100 μl of Trisol solution (Invitrogen) and stored at −80° C. The collected sample was subjected to RNA extraction according to the conventional method and then purified with an RNeasy mini kit (QIAGEN). On day 10 from the start of differentiation, a neurite was confirmed under a phase-contrast microscope for some wells.

Example 11

Expression Analysis of Candidate Genes by Quantitative PCR

Figure 31:
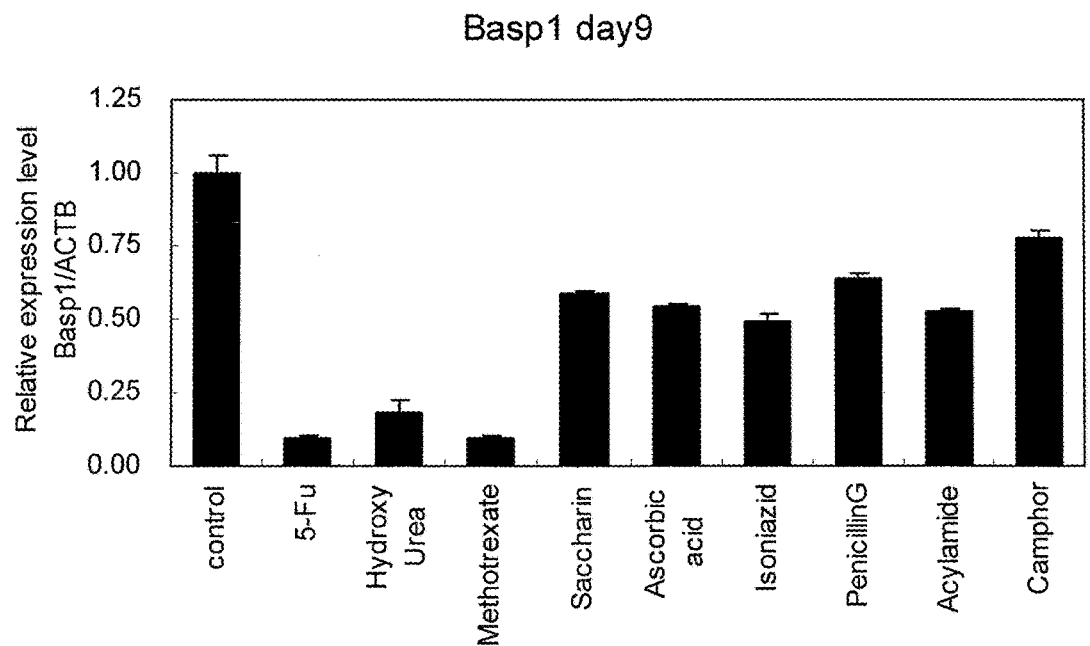
FIGS. 31 to 51 are drawings showing expression levels of marker genes for assessing embryotoxicity as relative expression levels, the expression levels being quantitated by using real-time PCR method for a solvent control group, groups treated with embryotoxic chemicals (5-fluorouracil, hydroxyurea and methotrexate) and groups treated with non-embryotoxic chemicals (saccharin sodium hydrate, ascorbic acid, isoniazid, penicillin G sodium salt, acrylamide and D-(+)-camphor).
Figure 32:
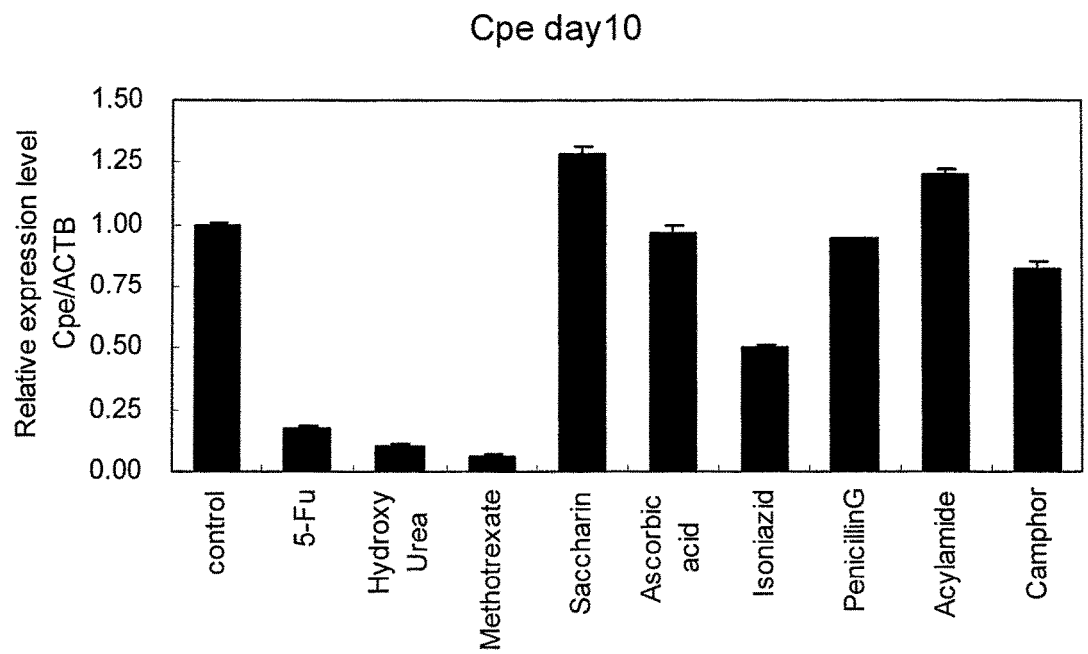
Figure 33:
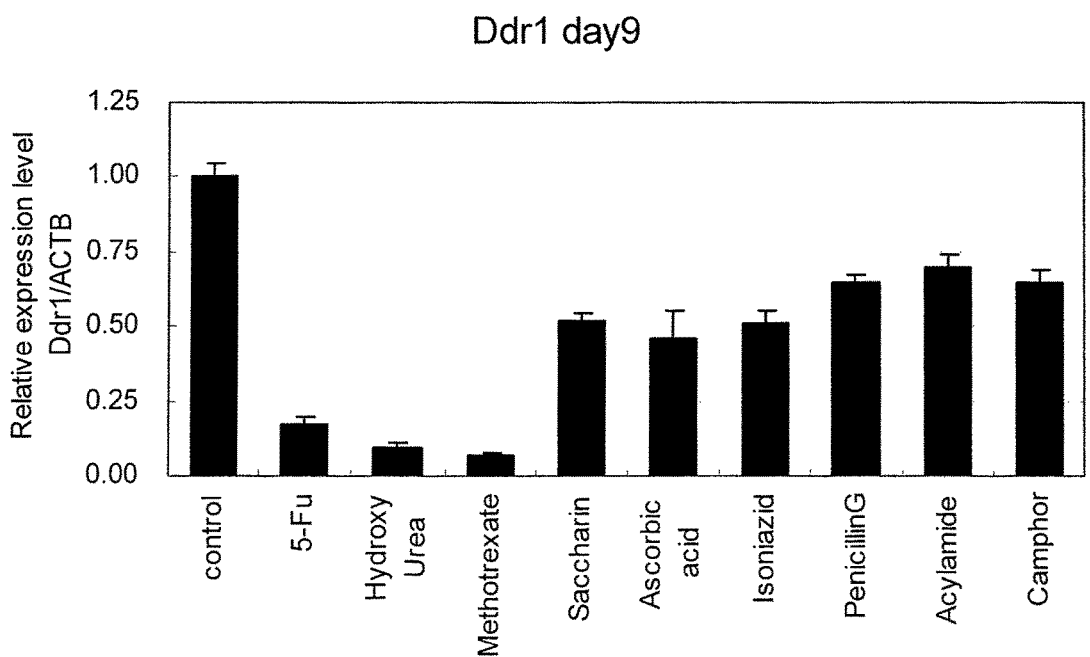
Figure 34:
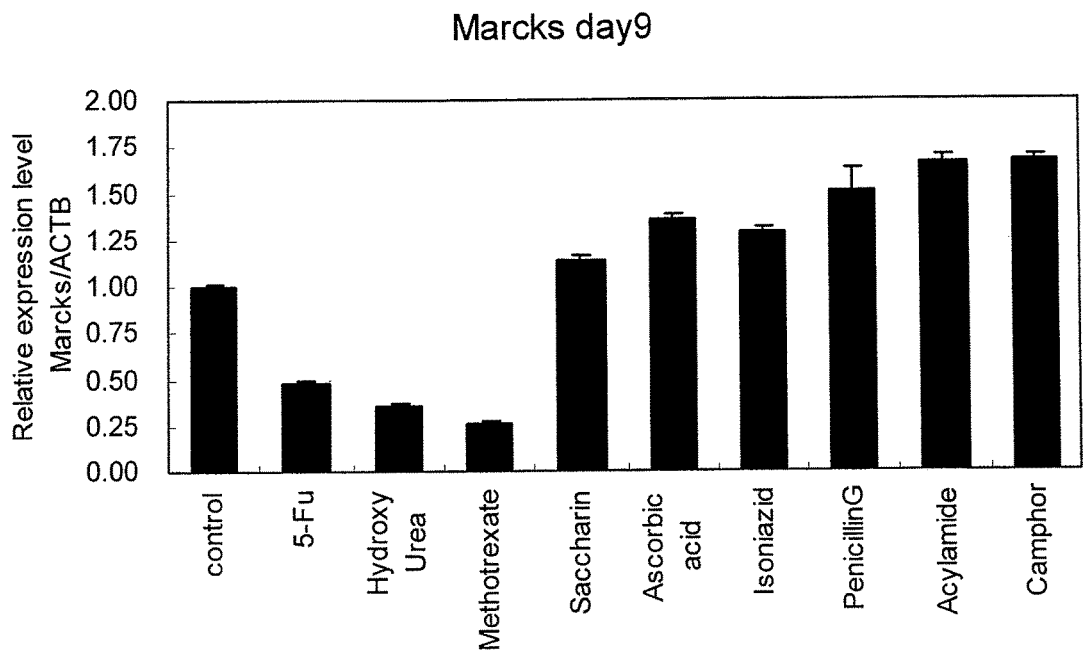
Figure 35:
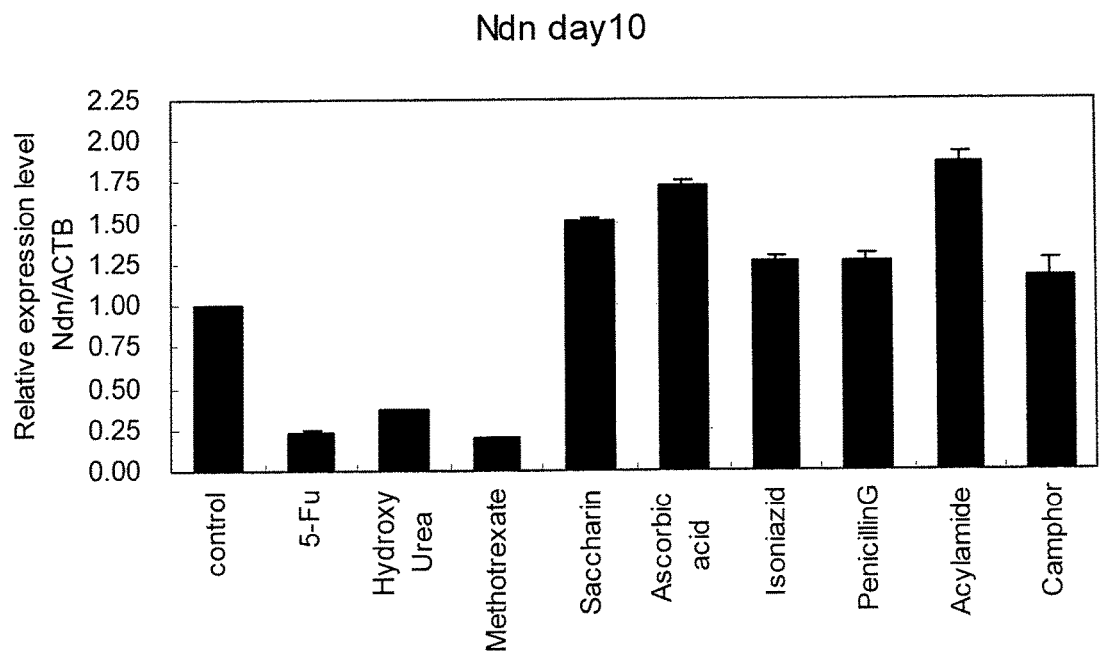
Figure 36:
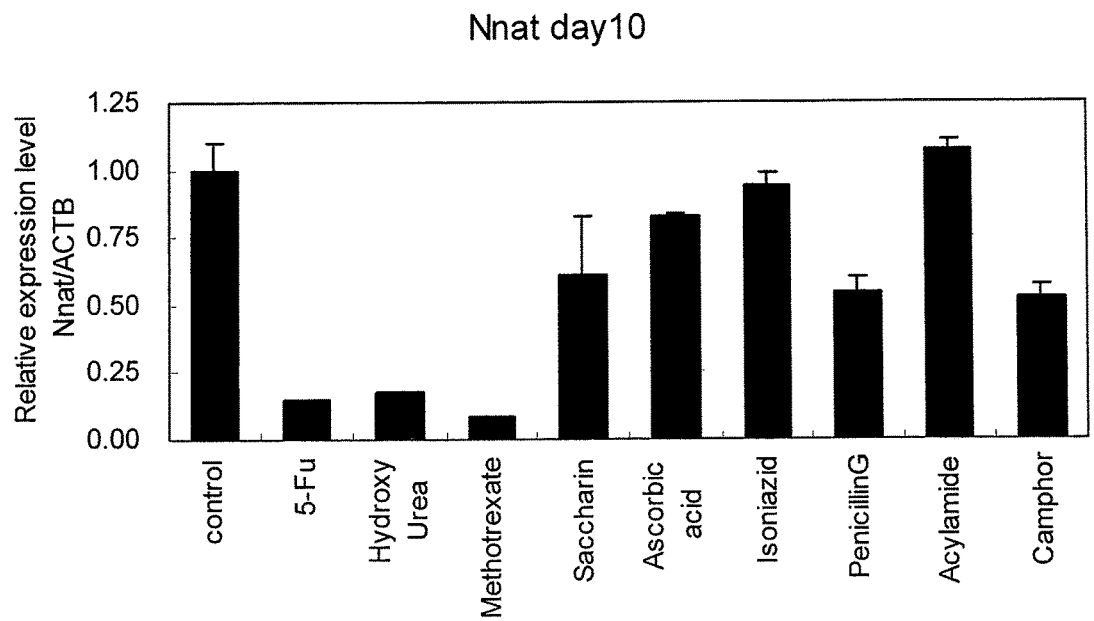
Figure 37:
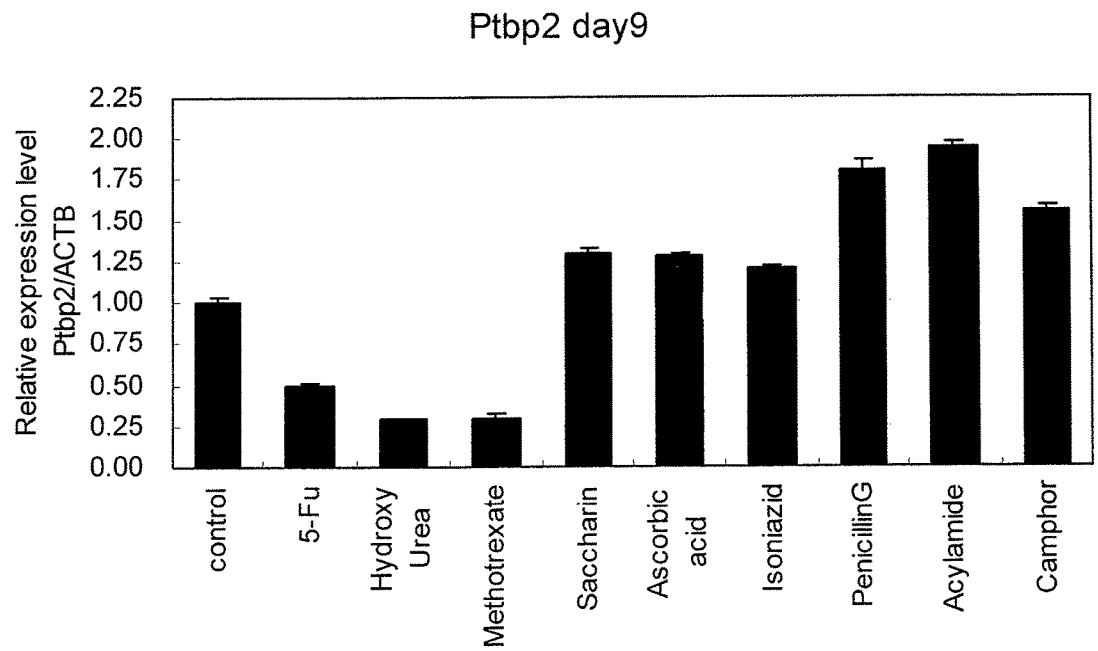
Figure 38:
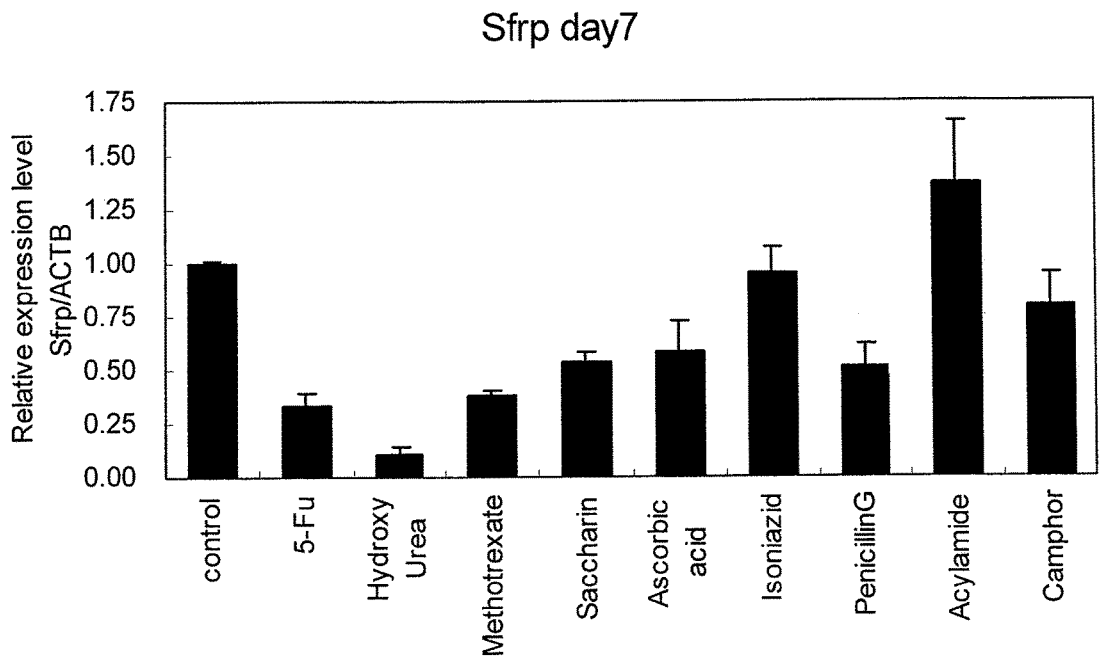
Figure 39:
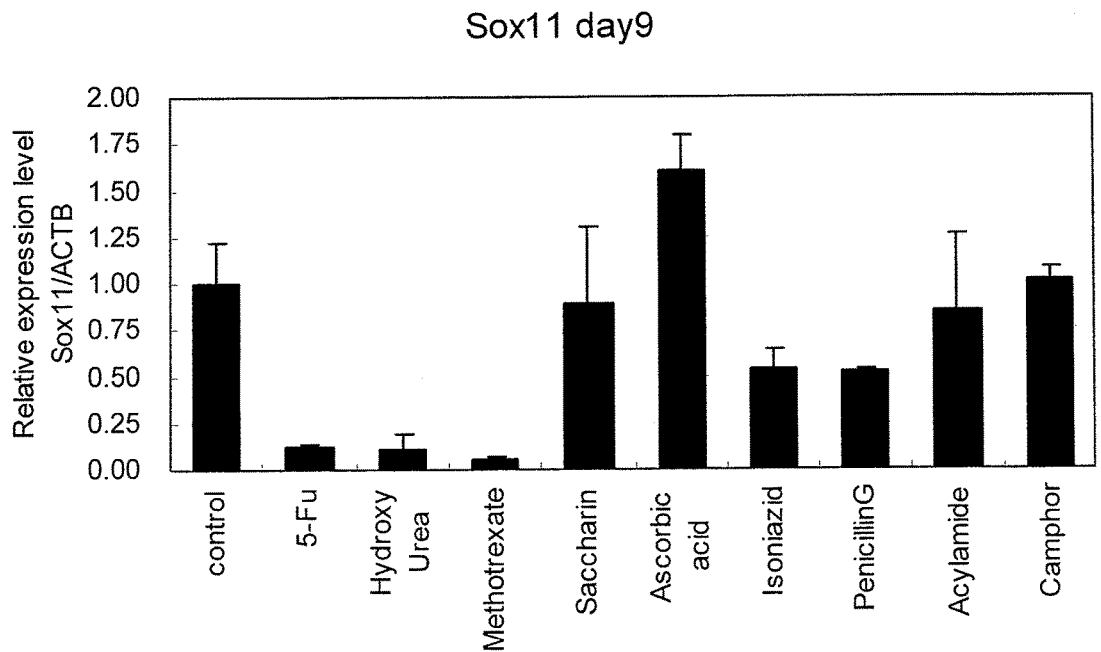
Figure 40:
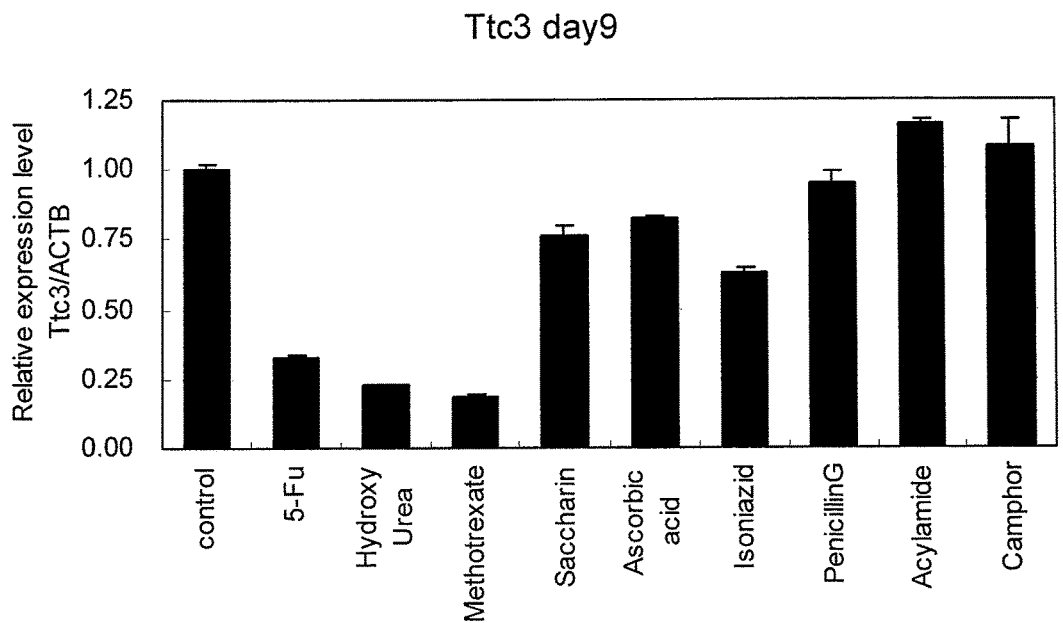
Figure 41:
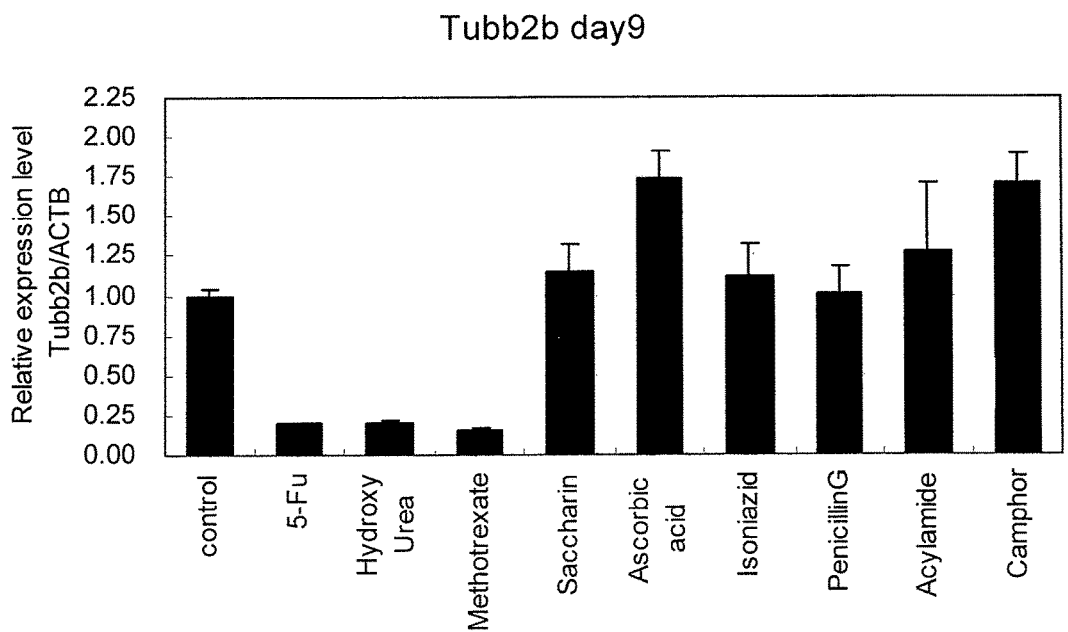
Figure 42:
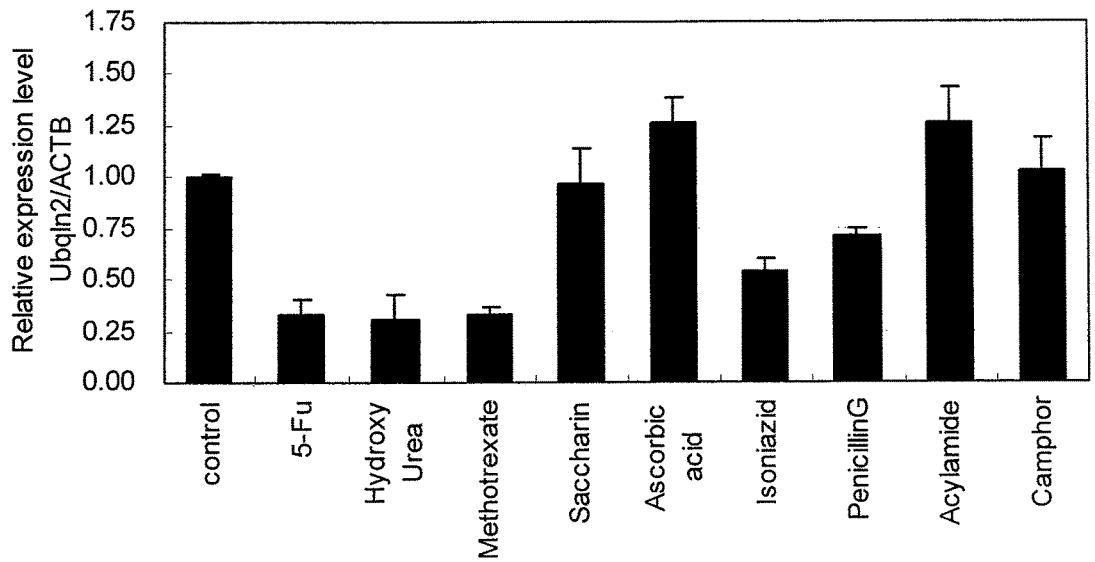
Figure 43:
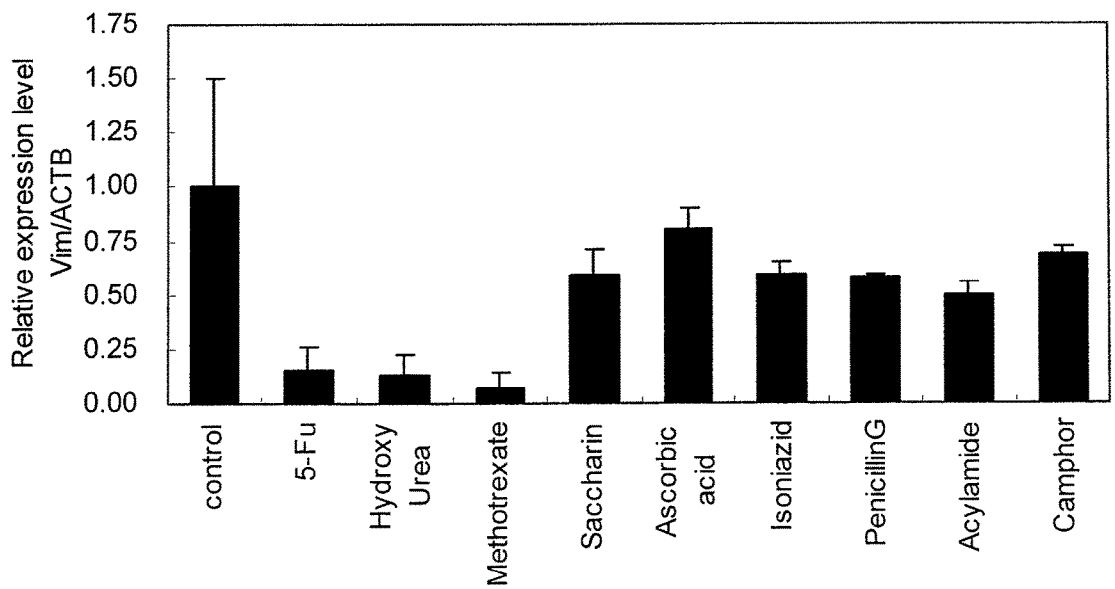
Figure 44:
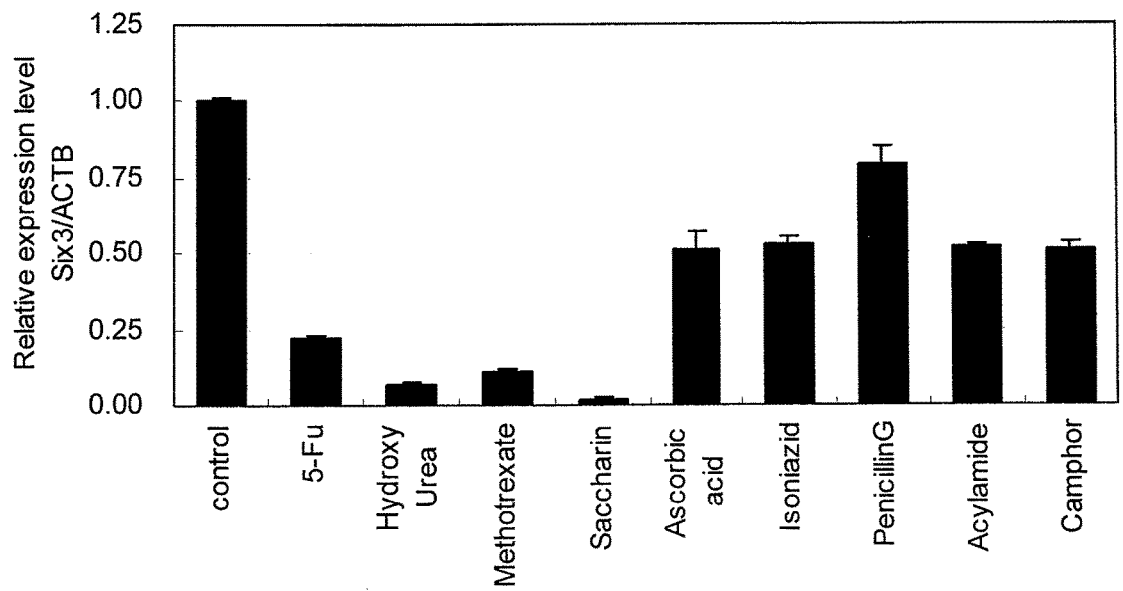
Figure 45:
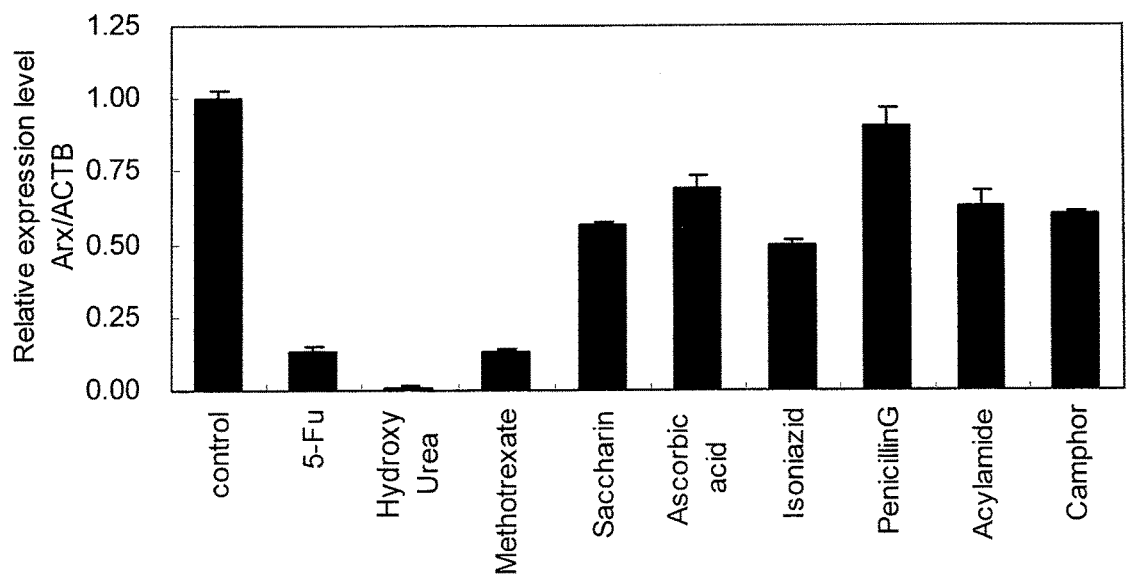
Figure 46:
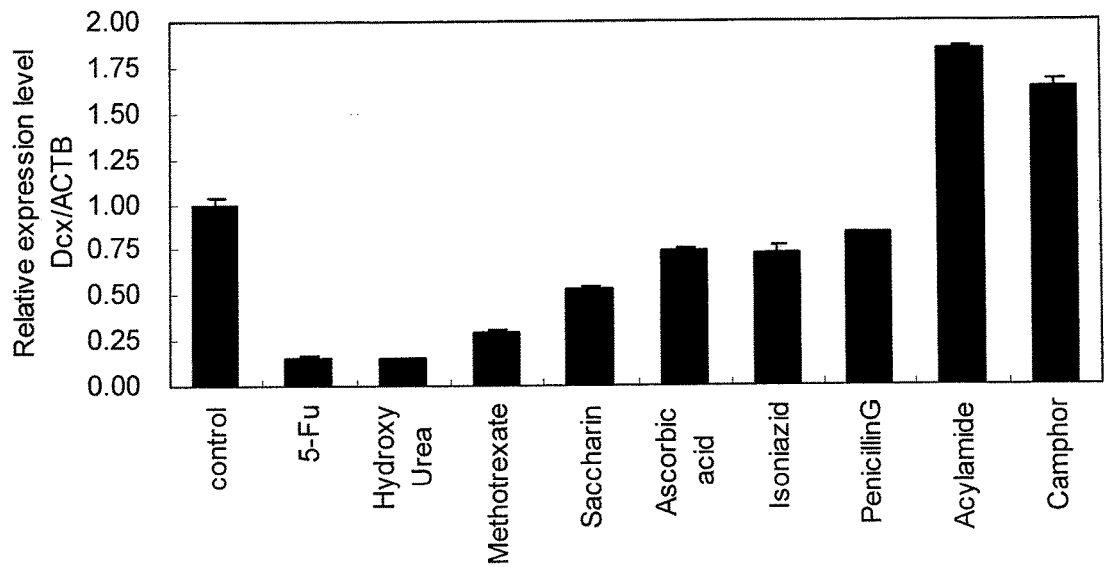
Figure 47:
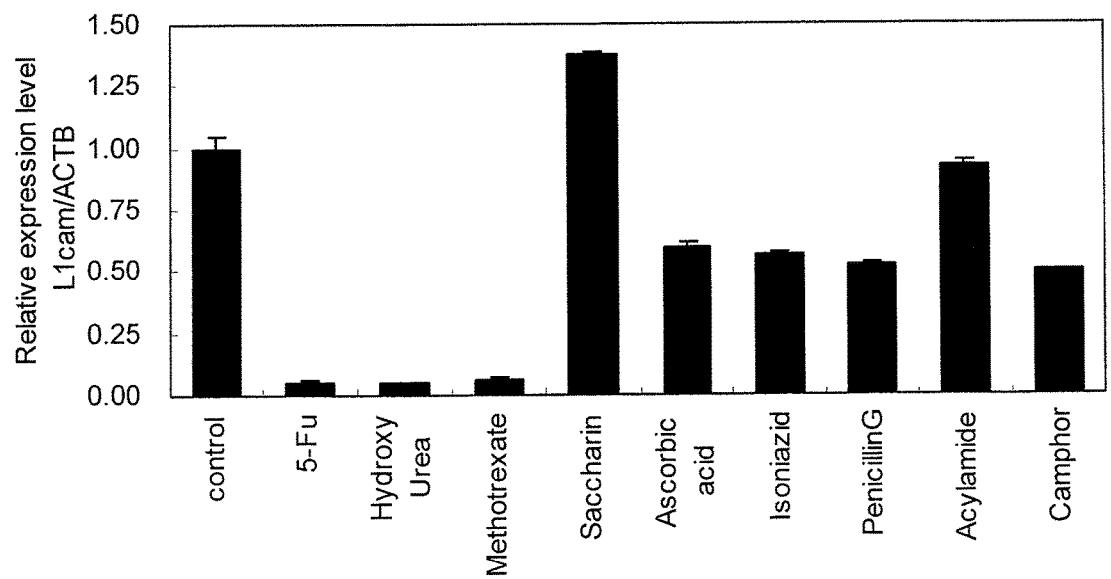
Figure 48:
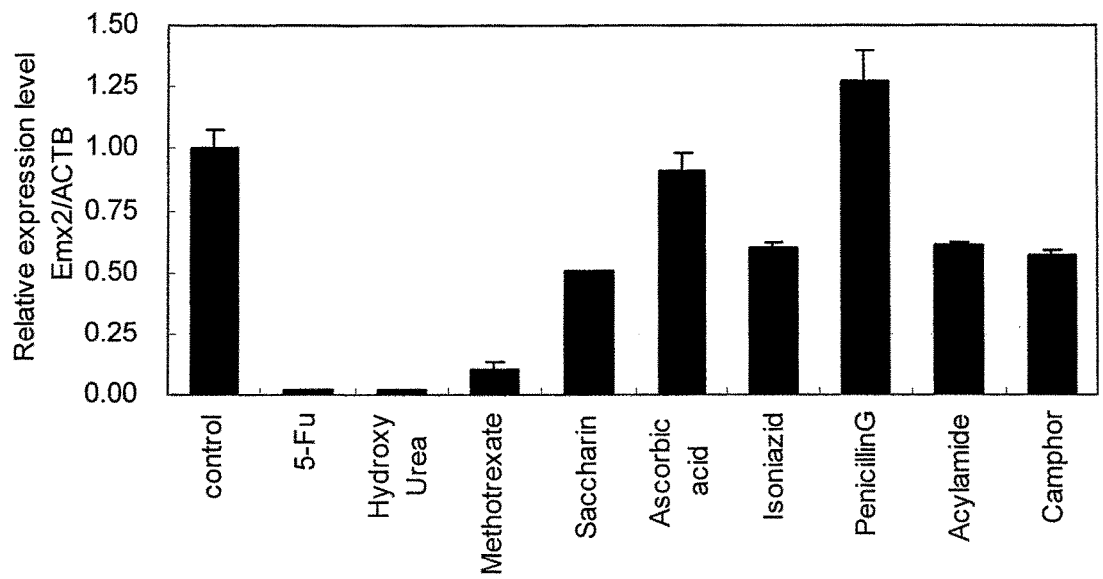
Figure 49:
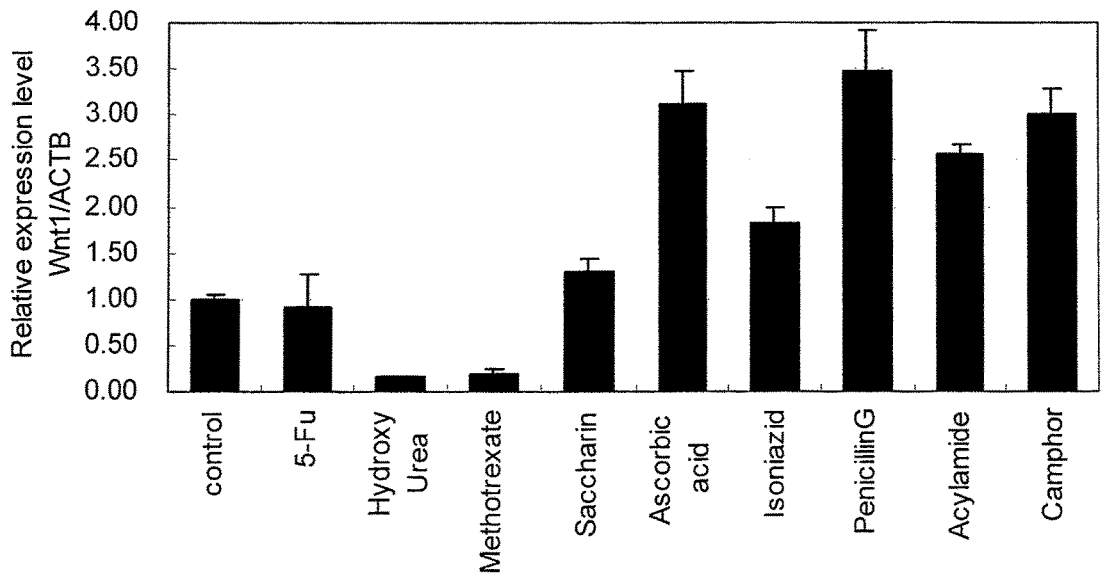
Figure 50:
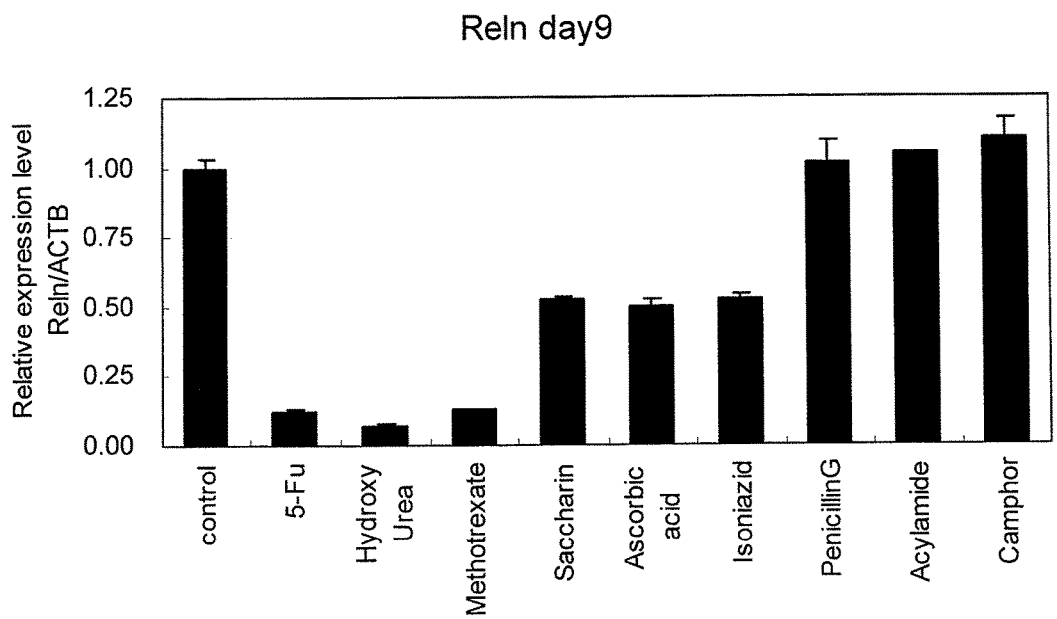
Figure 51:
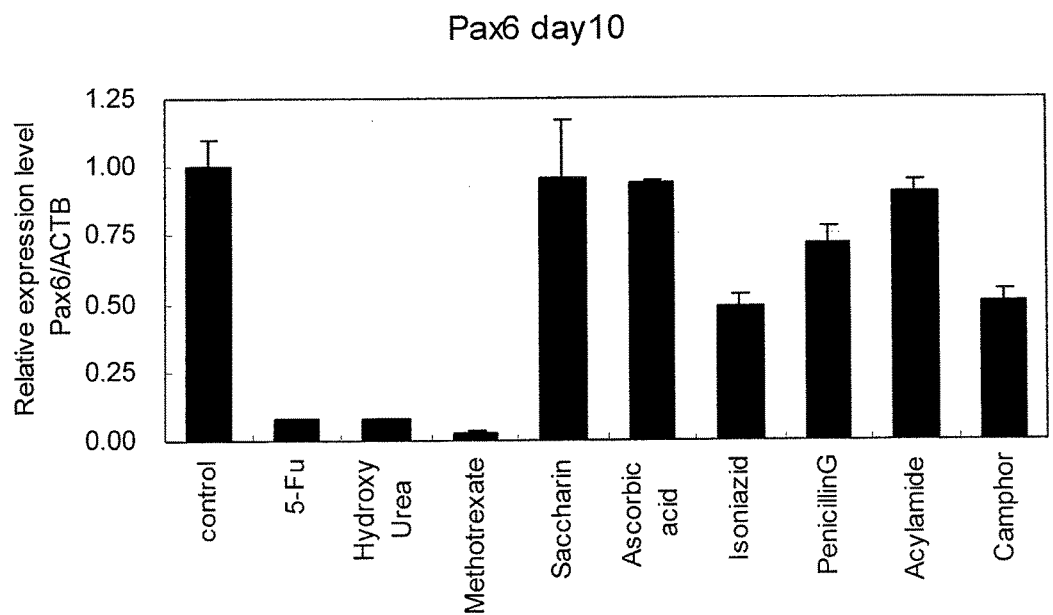

The concentration of the RNA extracted in Example 10 was measured using a RiboGreen RNA quantification kit (Invitrogen), and RNA equivalent to 300 ng was reacted at 42° C. for 1 hour using oligo dT primer and reverse transcriptases of Superscript III RT (Invitrogen), to give cDNA of each day. 1 μL of the resulting cDNA, 1 μL of TaqMan probe, and 8 μL of TaqMan Fast Universal PCR Master Mix (Applied Biosystems) were mixed in a test tube for analysis and kept at 95° C. for 10 minutes. Thereafter, PCR was performed using a 7900HT Real-time PCR system under the reaction conditions repeating 40 cycles of a reaction of 95° C. for 10 seconds and 60° C. for 20 seconds. PCR was performed with 3 repetitions for each sample. As the TaqMan probe for each gene used for the analysis, Mm02344032_s1 for Basp1 gene, Mm00516341_m1 for Cpe gene, Mm01273494_g1 for DDR1 gene, Mm02524303_s1 for Marcks gene, Mm02524479_s1 for NDN gene, Mm00731416_s1 for Nnat gene, Mm00497922_m1 for Ptbp2 gene, Mm01213947_m1 for Sfrp2 gene, Mm01281943_s1 for Sox11 gene, Mm00493917_m1 for Ttc3 gene, Mm00849948_g1 for Tubb2b gene, Mm00834570_s1 for Ubqln2 gene, Mm00449201_m1 for Vim gene, Mm01237639 ml for Six3 gene, Mm00545903_m1 for Arx gene, Mm00438401_m1 for Dcx gene, Mm00493049_m1 for L1cam gene, Mm00550241_m1 for Emx2 gene, Mm00810320_s1 for Wnt1 heredity, Mm00465200_m1 for Reln gene, and Mm00443081_m1 for Pax6 gene (all manufactured by Applied Biosystems) were used. In addition, using 1 μL of Pre-developed TaqMan Assay Reagents capable of analyzing mouse β actin gene and 1 μL of cDNA, PCR was performed in the same manner using a 7900HT Real-time PCR system, to obtain a data of the endogenous control. In the data obtained by the analysis, the expression level of the marker gene on each day of the differentiation induction was divided by the expression level of mouse β actin gene on the same day, whereby the expression level of each marker gene was evaluated. The measurement date was determined as the day when the expression of each marker gene was the highest. As a result, as shown in FIGS. 31 to 51, Basp1 gene, Cpe gene, DDR1 gene, Marcks gene, NDN gene, Nnat gene, Ptbp2 gene, Sfrp2 gene, Sox11 gene, Ttc3 gene, Tubb2b gene, Ubqln2 gene, Vim gene, Six3 gene, Arx gene, Dcx gene, L1cam gene, Emx2 gene, Wnt1 gene, Reln gene, and Pax6 gene were strongly suppressed in the groups treated with embryotoxic chemicals as compared to the groups treated with non-embryotoxic chemicals and identified as marker genes.

Example 12

Hereinbelow, a method for assessing the embryotoxicity of a test chemical using Hand1-ES cells transformed with a vector containing a reporter gene under the control of promoter expression of hand1 gene will be described.

Hand1-ES cell line was cultured while maintaining an undifferentiated state in DMEM medium containing 15% heat inactivated fetal bovine serum supplemented with LIF containing 100 μg/mL G418. The undifferentiated Hand1-ES cells were dispersed using 0.25% trypsin/1 mM EDTA, and thereafter, the cells were suspended in DMEM medium containing 15% heat inactivated fetal bovine serum. Residual trypsin was removed by centrifugation and suction of the supernatant, and the cells were suspended in DMEM medium containing 15% heat inactivated fetal bovine serum not containing LIF (hereinafter, medium for myocardial differentiation). Thereafter, the number of cells was counted using a small amount of the cell solution, and a cell suspension (medium for myocardial differentiation) was prepared so as to have a cell number of 15,000 cells/mL. The prepared cell suspensions were added with only solvent such as PBS(−) or DMSO as a solvent control or added with a test chemical prepared by diluting with solvent into several levels, and thereafter, each cell suspension was seeded in a nonadherent U-bottom 96-well plate in a volume of 50 μL, and the culture was performed for 3 days. On day 3, 50 μL of the medium for myocardial differentiation supplemented with the test chemical again prepared was added, and the suspension culture was continued for 3 days. On day 6, 100 μL of a luciferase luminescent reagent, Steady-Glo (Promega), was added to each well and shaken for 30 minutes, and thereafter, the total amount was transferred to a 96-well white plate, and the luciferase activity was measured with a TopCount NXT luminescence detection counter (Packard Japan). The obtained activity values were averaged and tallied for the solvent control group and every concentration of the test chemical.

Figure 52:
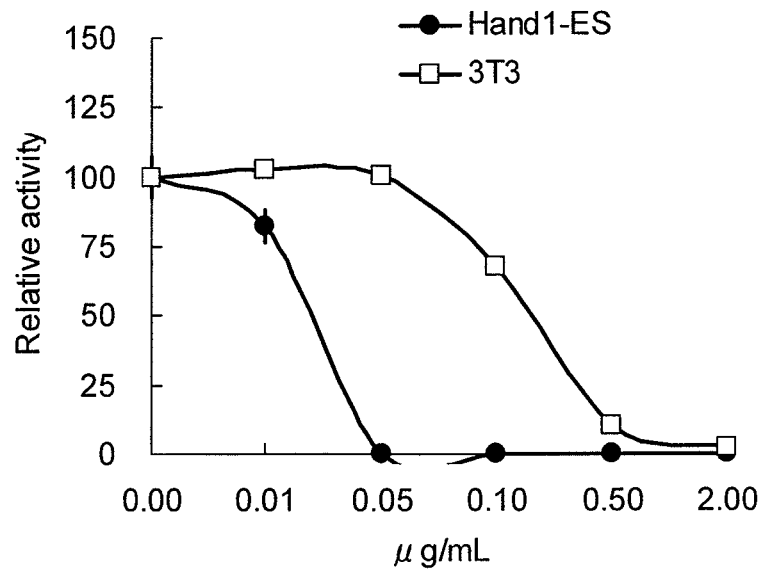
FIG. 52 is a drawing showing as a relative value to the solvent control the result of testing the effects on the reporter activity in Hand1-ES cells and the proliferation of 3T3 cells for 5-fluorouracil that is an embryotoxic chemical.
Figure 53:
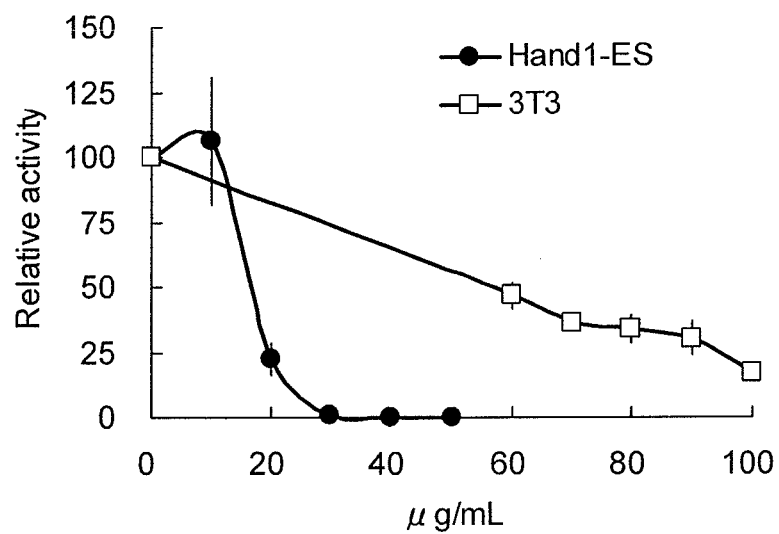
FIG. 53 is a drawing showing as a relative value to the solvent control the result of testing the effects on the reporter activity in Hand1-ES cells and the proliferation of 3T3 cells for dexamethasone that is an embryotoxic chemical.
Figure 54:
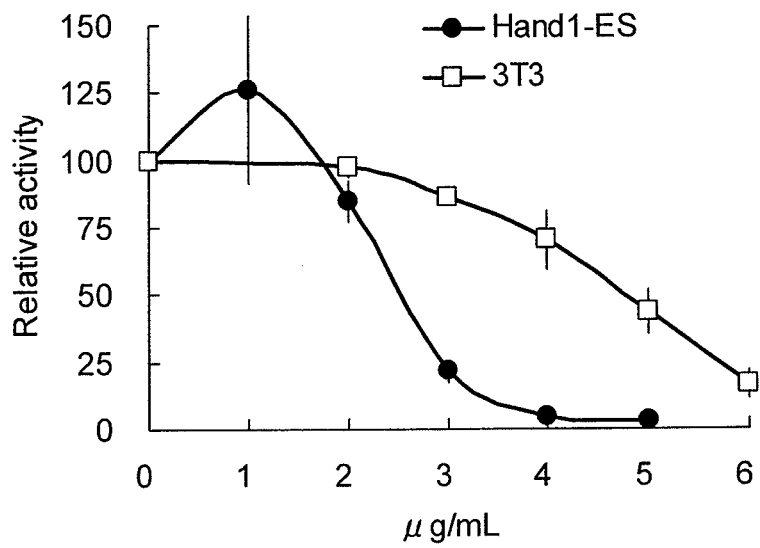
FIG. 54 is a drawing showing as a relative value to the solvent control the result of testing the effects on the reporter activity in Hand1-ES cells and the proliferation of 3T3 cells for hydroxyurea that is an embryotoxic chemical.
Figure 55:
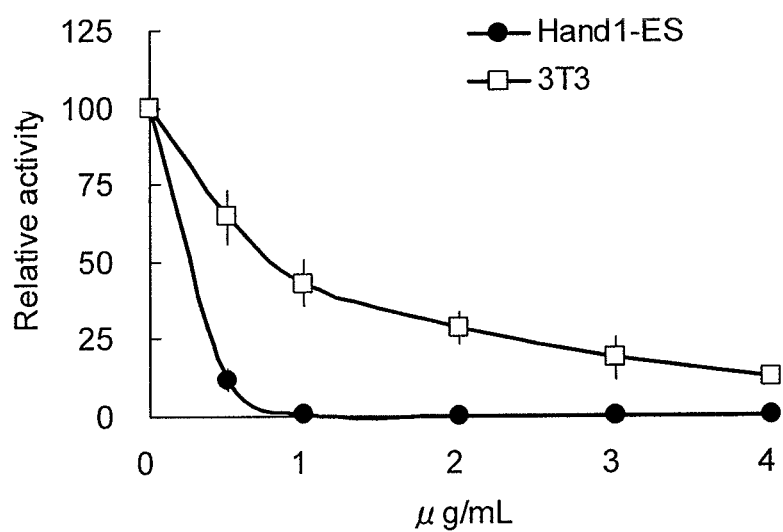
FIG. 55 is a drawing showing as a relative value to the solvent control the result of testing the effects on the reporter activity in Hand1-ES cells and the proliferation of 3T3 cells for 5-bromo-2'-deoxyuridine that is an embryotoxic chemical.
Figure 56:
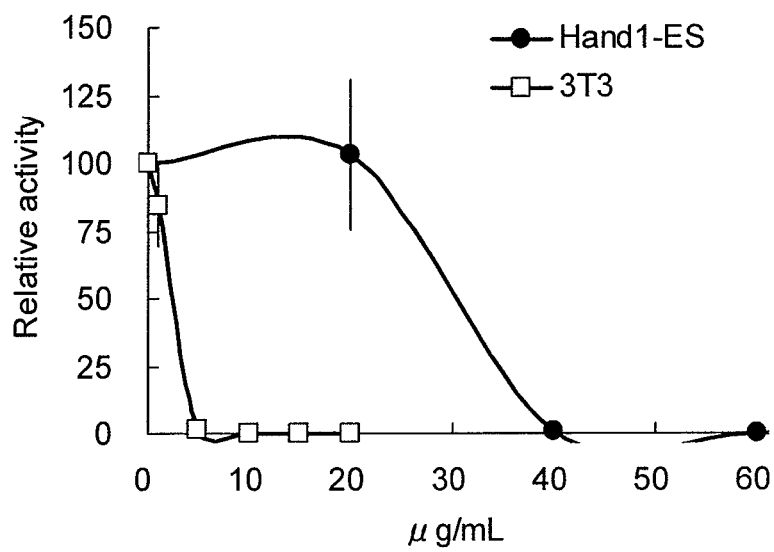
FIG. 56 is a drawing showing as a relative value to the solvent control the result of testing the effects on the reporter activity in Hand1-ES cells and the proliferation of 3T3 cells for ascorbic acid that is an embryotoxic chemical.
Figure 57:
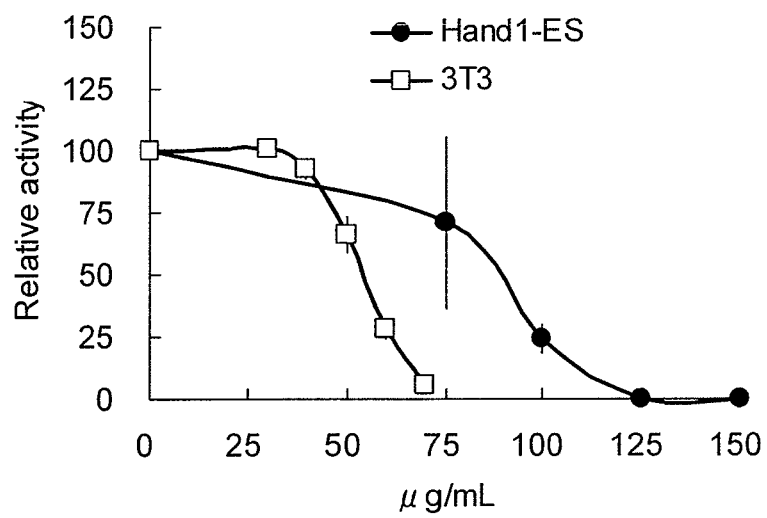
FIG. 57 is a drawing showing as a relative value to the solvent control the result of testing the effects on the reporter activity in Hand1-ES cells and the proliferation of 3T3 cells for acrylamide that is a non-embryotoxic chemical.

In addition, using balb/c 3T3 cells cloneA31 obtained from ATCC (hereinafter, 3T3 cells), the effects of each test chemical on cell proliferation were evaluated by the following method. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ were dispersed using 0.25% trypsin/1 mM EDTA, and thereafter, the cells were suspended in the medium for 3T3. Residual trypsin was removed by centrifugation and suction of the supernatant, and the cells were suspended in the medium for 3T3. Thereafter, the number of cells was counted using a small amount of the cell solution, and a cell suspension was prepared so as to have a cell number of 10,000 cells/mL. The prepared cell suspensions were added with only solvent such as PBS(−) or DMSO as a solvent control or added with a test chemical prepared by diluting with solvent into several levels. Thereafter, each cell suspension was seeded in a white 96-well plate for cell culture in a volume of 50 μL, and the culture was performed for 3 days. On day 3, 50 μL of the medium for 3T3 supplemented with the test chemical again prepared was added, and the culture was continued for 3 days. On day 6, the supernatant of each well was removed by suction, then, each well was supplemented with the solution in a CellTiter-Glo™ Luminescent Cell Viability Assay kit (Promega) and shaken for 30 minutes, and thereafter, the activity was measured with a TopCount NXT luminescence detection counter. 4 compounds (5-fluorouracil, hydroxyurea, dexamethasone, and 5-bromo-2'-deoxyuridine) in which in vivo embryotoxicity was positive and 2 compounds (ascorbic acid and acrylamide) in which in vivo embryotoxicity was negative were used as test chemicals. The activity values obtained from each test of the Hand1-ES cells and the 3T3 cells were averaged and tallied for the solvent control group and every concentration of the test chemical, and thereafter, a relative value of each concentration was calculated using the average value of the solvent control group as 100%. The results are shown in FIGS. 52 to 57.

As the effects of a chemical on a mother animal, the 50% inhibitory concentration for cell growth ($IC_{50}$) is measured using, for example, differentiated cells such as 3T3 cells, and as the effects of the chemical on a fetus, the 50% inhibitory concentration for differentiation ($ID_{50}$) is obtained from the measured value of the luciferase activity of the hand1-ES cells as the concentration that the 50% luciferase activity is inhibited. When the chemical has $ID_{50}$ smaller than $IC_{50}$, the chemical is considered to have stronger effect on a fetus as compared to on a mother animal, and it can be evaluated that the chemical has embryotoxicity. Regarding 4 compounds evaluated this time for which embryotoxicity is positive, the Hand1-ES $ID_{50}$ concentration and the 3T3 $ID_{50}$ concentration are each as follows: 5-fluorouracil (Hand1-ES $ID_{50}$: 0.02 μg/mL, 3T3 $IC_{50}$: 0.16 μg/mL), hydroxyurea (Hand1-ES $ID_{50}$: 2.5 μg/mL, 3T3 $IC_{50}$: 4.7 μg/mL), dexamethasone (Hand1-ES $ID_{50}$: 15.6 μg/mL, 3T3 $IC_{50}$: 36.7 μg/mL), and 5-bromo-2'-deoxyuridine (Hand1-ES $ID_{50}$: 0.12 μg/mL, 3T3 $IC_{50}$: 0.80 μg/mL), and the relationship of $ID_{50} < IC_{50}$ is recognized. Therefore, the chemical is considered to have stronger effect on a fetus as compared to on a mother animal, and it can be assessed that the chemical has embryotoxicity. In addition, regarding ascorbic acid and acrylamide for which embryotoxicity is negative, the Hand1-ES $ID_{50}$ concentration and the 3T3 $ID_{50}$ concentration are each as follows: ascorbic acid (Hand1-ES $ID_{50}$: 28.3 μg/mL, 3T3 $IC_5$: 2.0 μg/mL) and acrylamide (Hand1-ES $ID_{50}$: 85.3 μg/mL, 3T3 $IC_{50}$: 54.0 μg/mL). Since $ID_{50}$ in Hand1-ES is larger than $IC_{50}$ in 3T3, it is considered to have less effect on a fetus as compared to on a mother animal, and it can be assessed that embryotoxicity is not shown. According to the process described above, it is possible to assess embryotoxicity of a test chemical in a shorter time and more simply than the conventional EST method.

Example 13

A method for determining the embryotoxicity of a test chemical by measurement of the expression level of Hand1 will be described. First, a sample contacted with a test chemical is collected according to the following method. The ES cells cultured while maintaining an undifferentiated state are dispersed using 0.25% trypsin/1 mM EDTA, and thereafter, the cells are suspended in DMEM medium containing 15% heat inactivated fetal bovine serum. Residual trypsin is removed by centrifugation and suction of the supernatant, and the cells are suspended in DMEM medium containing 15% heat inactivated fetal bovine serum not containing LIF (hereinafter, medium for myocardial differentiation). Thereafter, the number of cells is counted using a small amount of the cell solution, and a cell suspension (medium for myocardial differentiation) is prepared so as to have a cell number of 15,000 cells/mL. The prepared cell suspensions are added with only solvent such as PBS(−) or DMSO as a solvent control or added with a test chemical prepared by diluting with solvent into several levels, and thereafter, each cell suspension is seeded in a nonadherent U-bottom 96-well plate in a volume of 50 µL, and the culture is performed for 3 days. On day 3, 50 µL of the medium for myocardial differentiation supplemented with the test chemical again prepared is added, and the suspension culture is continued for 3 days. On day 6, the cells in each well were collected and dissolved in 100 µl of Trisol solution (Invitrogen) and stored at −80° C. The collected sample is subjected to RNA extraction according to the conventional method and then purified with an RNeasy mini kit (QIAGEN). The concentration of RNA is determined, and thereafter, RNA equivalent to 300 ng is reacted at 42° C. for 1 hour using oligo dT primer and reverse transcriptases of Superscript III RT (Invitrogen), to give cDNA of each day. 1 µL of the resulting cDNA, 1 µL of TaqMan probe for evaluating Hand1 gene (Mm00433931_m1), and 8 µL of TaqMan Fast Universal PCR Master Mix (Applied Biosystems) are mixed in a test tube for analysis and kept at 95° C. for 10 minutes. Thereafter, PCR was performed using a 7900HT Real-time PCR system under the reaction conditions repeating 40 cycles of a reaction of 95° C. for 10 seconds and 60° C. for 20 seconds. PCR was performed with 3 repetitions for each sample. As the TaqMan probe for each gene for the analysis, Mm00433931_m1 is used for Hand1 gene. In addition, using 1 µL of Pre-developed TaqMan Assay Reagents capable of analyzing mouse β actin gene and 1 µL of cDNA, PCR is performed in the same manner using a 7900HT Real-time PCR system, to obtain a data of the endogenous control. The expression level of the hand1 gene of each sample is divided by the expression level of mouse β actin gene of the same sample, thereby evaluating the change in the expression level of the hand1 gene of each sample.

In addition, using 3T3 cells obtained from ATCC, the effects of each test chemical on cell proliferation are evaluated. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ are dispersed using 0.25% trypsin/1 mM EDTA, and thereafter, the cells are suspended in the medium for 3T3. Residual trypsin is removed by centrifugation and suction of the supernatant, and the cells are suspended in the medium for 3T3. Thereafter, the number of cells is counted using a small amount of the cell solution, and a cell suspension is prepared so as to have a cell number of 10,000 cells/mL. The prepared cell suspensions are added with only solvent such as PBS(−) or DMSO as a solvent control or added with a test chemical prepared by diluting with solvent into several levels, and thereafter, each cell suspension is seeded in a white 96-well plate for cell culture in a volume of 50 µL, and the culture is performed for 3 days. On day 3, 50 µL of the medium for 3T3 supplemented with the test chemical again prepared is added, and the culture is continued for 3 days. On day 6, the supernatant of each well is removed by suction, then, each well is supplemented with the solution in a CellTiter-Glo™ Luminescent Cell Viability Assay kit and shaken for 30 minutes, and thereafter, the activity is measured with a TopCount NXT luminescence detection counter. The relative expression levels of the Hand1 gene using real-time PCR and the activity values obtained from the test using the 3T3 cells are averaged and tallied for the solvent control group and every concentration of the test chemical, and thereafter, a relative value of each concentration is calculated using the average value of the solvent control group as 100%.

As the effects of a chemical on a mother animal, the 50% inhibitory concentration for cell growth ($IC_{50}$) is measured using, for example, differentiated cells such as 3T3 cells, and as the effects of the chemical on a fetus, the 50% inhibitory concentration for differentiation ($ID_{50}$) can be obtained as the concentration where 50% of the expression level of hand1 is inhibited. When the chemical has $ID_{50}$ smaller than $IC_{50}$, the chemical is considered to have stronger effect on a fetus as compared to on a mother animal, and it can be assessed that the chemical has embryotoxicity. Also, when $ID_{50}$ is larger than $IC_{50}$, it can be assessed that embryotoxicity is not shown.

Example 14

A method for determining embryotoxicity of a test chemical according to the method of measuring the expression level of a marker gene, Hand1, by flow cytometry or FACS. First, a sample contacted with a test chemical is collected according to the following method. The ES cells cultured while maintaining an undifferentiated state are dispersed using 0.25% trypsin/1 mM EDTA, and thereafter, the cells are suspended in DMEM medium containing 15% heat inactivated fetal bovine serum. Residual trypsin is removed by centrifugation and suction of the supernatant, and the cells are suspended in DMEM medium containing 15% heat inactivated fetal bovine serum not containing LIF (hereinafter, medium for myocardial differentiation). Thereafter, the number of cells is counted using a small amount of the cell solution, and a cell suspension (medium for myocardial differentiation) is prepared so as to have a cell number of 15,000 cells/mL. The prepared cell suspensions are added with only solvent such as PBS(−) or DMSO as a solvent control or added with a test chemical prepared by diluting with solvent into several levels, and thereafter, each cell suspension is seeded in a nonadherent U-bottom 96-well plate in a volume of 50 µL, and the culture is performed for 3 days. On day 3, 50 µL of the medium for myocardial differentiation supplemented with the test chemical again prepared is added, and the suspension culture is continued for 3 days. On day 6, the cells in each well are collected and dispersed using trypsin/EDTA solution, and thereafter, the cells are immobilized with a paraformaldehyde solution.

The cells are permeabilized with Saponin solution or the like, and thereafter, blocking is performed with normal goat serum. Anti-hand1 antibody (Abcam pic.) or anti-eHAND (H-100) antibody (Santa Cruz Biotechnology, Inc.) recognizing Hand1 gene product (protein) are added thereto, and the mixture is reacted for several hours and then washed 3 times or so. Also, a labeled secondary antibody such as a fluorescent substance recognizing the primary antibody is allowed to react, and thereafter, the mixture was washed 3 times or so. In each sample obtained by the process described above, the positive cells expressing hand1 gene product (hereinafter, hand1 positive cells) are calculated by flow cytometry such as Epics Altra (Beckman Coulter).

In addition, using 3T3 cells obtained from ATCC, the effects of each test chemical on cell proliferation are evaluated. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ are dispersed using 0.25% trypsin/1 mM EDTA, and thereafter, the cells are suspended in the medium for 3T3. Residual trypsin is removed by centrifugation and suction of the supernatant, and the cells are suspended in the medium for 3T3. Thereafter, the number of cells is counted using a small amount of the cell solution, and a cell suspension is prepared so as to have a cell number of 10,000 cells/mL. The prepared cell suspensions are added with only solvent such as PBS(−) or DMSO as a solvent control or added with a test chemical prepared by diluting with solvent into several levels, and thereafter, each cell suspension is seeded in a white 96-well plate for cell culture in a volume of 50 μL, and the culture is performed for 3 days. On day 3, 50 μL of the medium for 3T3 supplemented with the test chemical again prepared is added, and the culture is continued for 3 days. On day 6, the supernatant of each well is removed by suction, then, each well is supplemented with the solution in a CellTiter-Glo™ Luminescent Cell Viability Assay kit and shaken for 30 minutes, and thereafter, the activity is measured with a TopCount NXT luminescence detection counter. The number of Hand1 positive cells using flow cytometry and the activity values obtained from the test using the 3T3 cells are averaged and tallied for the solvent control group and every concentration of the test chemical, and thereafter, a relative value of each concentration is calculated using the average value of the solvent control group as 100%.

As the effects of a chemical on a mother animal, the 50% inhibitory concentration for cell growth ($IC_{50}$) is measured using, for example, differentiated cells such as 3T3 cells, and as the effects of the chemical on a fetus, the 50% inhibitory concentration for differentiation ($ID_{50}$) can be obtained as the concentration where 50% of the number of hand1 positive cells is inhibited. When the chemical has $ID_{50}$ smaller than $IC_{50}$, the chemical is considered to have stronger effect on a fetus as compared to on a mother animal, and it can be assessed that the chemical has embryotoxicity. Also, when $ID_{50}$ is larger than $IC_{50}$, it can be assessed that embryotoxicity is not shown.

Example 15

Hereinbelow, a method for preparing ES cells transformed with a vector containing a reporter gene under the control of promoter expression of a marker gene in the neural differentiation process will be described.

(Cloning of Promoter of Marker Gene and Preparation of Reporter Plasmid in Neural Differentiation Process)

A promoter region of each marker gene in the present invention is cloned by PCR using the primers as shown below.

When 5 kb of the promoter region of Ndn gene is amplified, the primer depicted in SEQ ID NO: 231 and the primer depicted in SEQ ID NO: 232 are used. 20 ng of genomic DNA extracted from ES-D3 cells and the each primer prepared as 10 μM are amplified by PCR method using Platinum Taq polymerase (Invitrogen). PCR reaction is performed with a GeneAmp PCR System 9700 (Applied Biosystems), using the reaction conditions of 95° C. for 5 minutes, followed by 30 cycles of 95° C. for 30 seconds, 55° C. for 30 seconds, and 72° C. for 1 minute, and 72° C. for 7 minutes.

When 5 kb of the promoter region of Cpe gene is amplified, the primer depicted in SEQ ID NO: 233 and the primer depicted in SEQ ID NO: 234 are used.

When 5 kb of the promoter region of L1cam gene is amplified, the primer depicted in SEQ ID NO: 235 and the primer depicted in SEQ ID NO: 236 are used.

When 5 kb of the promoter region of L1cam gene is amplified, the primer depicted in SEQ ID NO: 237 and the primer depicted in SEQ ID NO: 238 are used.

Each PCR product is electrophoresed and then purified from the gel, and the purified DNA fragments are each subjected to the terminal phosphorylation reaction. Each fragment is digested using EcoR V, then linked using pGL4.17 [Luc2/Neo]vector (Promega) dephosphorylated with Alkaline phosphatase (TAKARA BIO INC.) and Ligation kit (TAKARA BIO INC.), transformed into DH5α competent cells (TAKARA BIO INC.) and cultured overnight in LB/ampicillin medium at 37° C. The appeared colonies are cultured in LB/ampicillin liquid medium, and plasmid DNA is extracted from the proliferated *E. coli*. The sequence of an insert fragment of the obtained plasmid DNA is determined, and the presence or absence of mutation or the like is confirmed. In order to use for transfection into ES cells, each plasmid is extracted again with an Qiafilter plasmid extraction kit (QIAGEN). 20 μg of the resulting plasmid DNA is digested with a suitable restriction enzyme and then purified to obtain linearized DNA.

(Method for Preparing Recombinant ES Cells of Marker Gene in Neural Differentiation Process)

The ES-D3 cells cultured while maintaining an undifferentiated state are dispersed using 0.25% trypsin/1 mM EDTA, and thereafter, $0.3 \times 10^5$ cells are seeded in a 0.1% gelatin-coated 35 mm petri dish and cultured in DMEM medium containing 15% heat inactivated fetal bovine serum supplemented with LIF. Thereafter, Opti-MEM medium, 4 μg of the linearized DNA, and 12 μL of Lipofectamine 2000 (Invitrogen) are mixed and allowed to react at room temperature for 30 minutes, and then the total amount is added to the cell culture.

After culturing in an incubator at 37° C. and 5% $CO_2$ for 1 hour, the medium is replaced with DMEM medium containing 15% heat inactivated fetal bovine serum supplemented with LIF. After 12 hours, each cell is dispersed using 0.25% trypsin/1 mM EDTA and then seeded in a 0.1% gelatin-coated 10 cm petri dish using DMEM medium containing 15% heat inactivated fetal bovine serum supplemented with LIF containing 100 μg/mL G418 (Invitrogen), and drug selection culture is started. After 7 to 10 days, the ES cell colonies formed in the petri dish are isolated under a stereomicroscope and seeded in a 96-well plate, and drug selection culture is continued. With replacing the medium every 3 days, the cells proliferated after 7 to 10 days are subcultured and seeded in a 48-well plate, and drug selection culture is continued to obtain a drug-resistant stably-transformed cell line.

(Method for Selecting Cell Line)

The obtained cell line is cultured while maintaining an undifferentiated state in DMEM medium containing 15% heat inactivated fetal bovine serum supplemented with LIF containing 100 μg/mL G418, and dispersed using 0.25% trypsin/1 mM EDTA. The cells are suspended in DMEM medium containing 15% heat inactivated fetal bovine serum, and thereafter, residual trypsin and serum are removed by centrifugation and suction of the supernatant, and the cells are suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells is counted using a small amount of the cell solution, and thereafter, the cell suspension is prepared to a cell density of $5 \times 10^5$ cells/mL and then seeded in a nonadherent U-bottom 96-well plate in a volume of 50 μL, and the culture is performed in an incubator at 37° C. and 5% $CO_2$ or an incubator at 37° C., 5% $CO_2$, and 5% $O_2$ for 3 days. On day 3 from the start of differentiation, 50 μL of neural differentiation medium is added, and the suspension culture is continued. The embryoid bodies formed in the nonadherent U-bottom 96-well plate are seeded in each well of a Poly-D-Lysine/Laminine-coated 96-well plate treated with fibronectin/PBS(−) solution prepared as 5 μg/mL, and the induction of neural differentiation is continued for further 5 days in an incubator at 37° C. and 5% $CO_2$ or an incubator at 37° C., 5% $CO_2$, and 5% $O_2$. For each of the cell lines, cells of 24 wells or more are collected every 2 days for 10 days and defined as 1 sample. Then, RNA extraction is carried out according to the conventional method, and the extracted RNA is thereafter purified with an RNaeasy mini kit (QIAGEN). The RNA concentration is measured using a RiboGreen kit (Invitrogen), and thereafter, RNA equivalent to 1 μg is reacted at 42° C. for 1 hour using oligo dT primer and reverse transcriptases of Superscript III RT (Invitrogen) to synthesize cDNA. For samples at day 0, day 2, day 4, day 6, day 8, and day 10 of each of the cell lines, PCR is performed using a primer pair capable of amplifying Luc2 gene (5'-agtagtggcagtaccggat-3' (SEQ ID NO: 239) and 5'-ctcgtgcaagttgcttagg-3' (SEQ ID NO: 240)) and ExTaq polymerase (TAKARA BIO INC.), and thereafter, gel electrophoresis of the PCR product is performed. Also, the expression levels of each marker gene and β actin gene are compared, and a cell line that induces the expression of Luc2 gene with differentiation induction is selected. Furthermore, measurement of the luciferase activity of the selected cell line after differentiation induction is performed as follows. First, the cell line is cultured according to the method for inducing neural differentiation described above, and thereafter, on each day from day 6 to day 10 from the start of differentiation induction, 50 μL of a luciferase luminescent reagent, Steady-Glo, is added to each well of a 96-well plate. After shaking for 30 minutes, the luciferase activity is measured with a TopCount NXT luminescence detection counter (Packard Japan). The ES cells that agree in the luciferase activity and the expression pattern of the endogenous marker gene of the ES cells transformed with a vector containing a reporter gene under the control of promoter expression of a marker gene in the neural differentiation process are selected, and each cell line is named as Ndn-ES cell, Cpe-ES cell, L1 cam-ES cell, and Pax6-ES cell.

Example 16

Hereinbelow, a method for assessing embryotoxicity of a test chemical using Ndn-ES cells, Cpe-ES cells, L1cam-ES cells and Pax6-ES cells transformed with a vector containing a reporter gene under the control of promoter expression of a marker gene in the neural differentiation process will be described. Each cell line is cultured while maintaining an undifferentiated state in DMEM medium containing 15% heat inactivated fetal bovine serum supplemented with LIF containing 100 μg/mL G418, and then dispersed using 0.25% trypsin/1 mM EDTA. The cells are suspended in DMEM medium containing 15% heat inactivated fetal bovine serum, and thereafter, residual trypsin and serum are removed by centrifugation and suction of the supernatant, and the cells are suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells is counted using a small amount of the cell solution, and thereafter, the cell suspension is prepared to a cell density of $5 \times 10^5$ cells/mL. The prepared cell suspensions are added with only solvent such as PBS(−) or DMSO as a solvent control or added with a test chemical prepared by diluting with solvent into several levels, and thereafter, each cell suspension is seeded in a nonadherent U-bottom 96-well plate in a volume of 50 μL, and the culture is performed in an incubator at 37° C. and 5% $CO_2$ or an incubator at 37° C., 5% $CO_2$, and 5% $O_2$ for 3 days. On day 3 from the start of differentiation, 50 μL of neural differentiation medium is added, and the suspension culture is continued. The embryoid bodies formed in the nonadherent U-bottom 96-well plate are seeded in each well of a Poly-D-Lysine/Laminine-coated 96-well plate treated with fibronectin/PBS(−) solution prepared as 5 μg/mL, and the induction of neural differentiation is continued for further 5 days in an incubator at 37° C. and 5% $CO_2$ or an incubator at 37° C., 5% $CO_2$, and 5% $O_2$. On day 8 to 10 from the start of differentiation induction, 100 μL of a luciferase luminescent reagent, Steady-Glo (Promega), is added to each well and shaken for 30 minutes, and thereafter, the total amount is transferred to a 96-well white plate, and the luciferase activity is measured with a TopCount NXT luminescence detection counter (Packard Japan). The obtained activity values are averaged and tallied for the solvent control group and every concentration of the test chemical.

In addition, using 3T3 cells cloneA31 obtained from ATCC (hereinafter, 3T3 cells), the effects of each test chemical on cell proliferation are evaluated. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ are dispersed using 0.25% trypsin/1 mM EDTA, and thereafter, the cells are suspended in the medium for 3T3. Residual trypsin is removed by centrifugation and suction of the supernatant, and the cells are suspended in the medium for 3T3. Thereafter, the number of cells is counted using a small amount of the cell solution, and a cell suspension is prepared so as to have a cell number of 10,000 cells/mL. The prepared cell suspensions are added with only solvent such as PBS(−) or DMSO as a solvent control or added with a test chemical prepared by diluting with solvent into several levels, and thereafter, each cell suspension is seeded in a white 96-well plate for cell culture in a volume of 50 µL, and the culture is performed for 3 days. On day 3, 50 µL of the medium for 3T3 supplemented with the test chemical again prepared is added, and the culture is continued for 3 days. On day 8 to 10 from the start of differentiation induction, the supernatant of each well is removed by suction, then, each well is supplemented with the solution in a CellTiter-Glo™ Luminescent Cell Viability Assay kit (Promega) and shaken for 30 minutes, and thereafter, the activity is measured with a TopCount NXT luminescence detection counter. The activity values obtained from the each test of Ndn-ES cells, Cpe-ES cells, L1cam-ES cells, Pax6-ES cells, and the 3T3 cells are averaged and tallied for the solvent control group and every concentration of the test chemical, and thereafter, a relative value of each concentration is calculated using the average value of the solvent control group as 100%.

As the effects of a chemical on a mother animal, the 50% inhibitory concentration for cell growth ($IC_{50}$) is measured using, for example, a differentiated cell such as 3T3 cells, and as the effects of the chemical on a fetus, the 50% inhibitory concentration for differentiation ($ID_{50}$) is obtained from the measured values of the luciferase activities of the Ndn-ES cells, Cpe-ES cells, L1cam-ES cells, and Pax6-ES as the concentration that the 50% luciferase activity is inhibited. When the chemical has $ID_{50} < IC_{50}$, the chemical is considered to have stronger effect on a fetus as compared to on a mother animal, and it can be assessed that the chemical has embryotoxicity. According to the process described above, it is possible to assess embryotoxicity of a test chemical during the neural differentiation.

Example 17

A method for determining embryotoxicity of a test chemical by measurement of the expression level of a marker gene in the neural differentiation process will be described. First, a sample contacted with a test chemical is collected according to the following method. The ES cells cultured while maintaining an undifferentiated state are dispersed using 0.25% trypsin/1 mM EDTA. The cells are suspended in DMEM medium containing 15% heat inactivated fetal bovine serum, and thereafter, residual trypsin and serum are removed by centrifugation and suction of the supernatant, and the cells are suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells is counted using a small amount of the cell solution, and thereafter, the cell suspension is prepared to a cell density of $5 \times 10^5$ cells/mL. The prepared cell suspensions are added with only solvent such as PBS(−) or DMSO as a solvent control or added with a test chemical prepared by diluting with solvent into several levels, and thereafter, each cell suspension is seeded in a nonadherent U-bottom 96-well plate in a volume of 50 µL, and the culture is performed in an incubator at 37° C. and 5% $CO_2$ or an incubator at 37° C., 5% $CO_2$, and 5% $O_2$ for 3 days. On day 3 from the start of differentiation, 50 µL of neural differentiation medium is added, and the suspension culture is continued. The embryoid bodies formed in the nonadherent U-bottom 96-well plate are seeded in each well of a Poly-D-Lysine/Laminine-coated 96-well plate treated with fibronectin/PBS(−) solution prepared as 5 µg/mL, and the induction of neural differentiation is continued for further 5 days in an incubator at 37° C. and 5% $CO_2$ or an incubator at 37° C., 5% $CO_2$, and 5% $O_2$. On day 8 to 10, the cells in each well are collected and dissolved in 100 µl of Trisol solution (Invitrogen) and stored at −80° C. The collected sample is subjected to RNA extraction according to the conventional method and then purified with an RNeasy mini kit (QIAGEN). The concentration of RNA is determined, and thereafter, RNA equivalent to 300 ng is reacted at 42° C. for 1 hour using oligo dT primer and reverse transcriptases of Superscript III RT (Invitrogen) to give cDNA of each day. 1 µL of the resulting cDNA, 1 µL of TaqMan probe, and 8 µL of TaqMan Fast Universal PCR Master Mix (Applied Biosystems) are mixed in a test tube for analysis and kept at 95° C. for 10 minutes. Thereafter, PCR is performed using a 7900HT Real-time PCR system under the reaction conditions repeating 40 cycles of a reaction of 95° C. for 10 seconds and 60° C. for 20 seconds. PCR is performed with 3 repetitions for each sample. As the TaqMan probe for each gene for the analysis, the probe described in Example 11 is used. In addition, using 1 µL of Pre-developed TaqMan Assay Reagents capable of analyzing mouse β actin gene and 1 µL of cDNA, PCR is performed in the same manner using a 7900HT Real-time PCR system, to obtain a data of the endogenous control. In the data obtained by the analysis, the expression level of the marker gene of each sample is divided by the expression level of mouse β actin gene of the same sample, thereby evaluating the change in the expression level of the marker gene of each sample.

In addition, using 3T3 cells obtained from ATCC, the effects of each test chemical on cell proliferation are evaluated. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ are dispersed using 0.25% trypsin/1 mM EDTA, and thereafter, the cells are suspended in the medium for 3T3. Residual trypsin is removed by centrifugation and suction of the supernatant, and the cells are suspended in the medium for 3T3. Thereafter, the number of cells is counted using a small amount of the cell solution, and a cell suspension is prepared so as to have a cell number of 10,000 cells/mL. The prepared cell suspensions are added with only solvent such as PBS(−) or DMSO as a solvent control or added with a test chemical prepared by diluting with solvent into several levels, and thereafter, each cell suspension is seeded in a white 96-well plate for cell culture in a volume of 50 µL, and the culture is performed for 3 days. On day 3, 50 µL of the medium for 3T3 supplemented with the test chemical again prepared is added, and the culture is continued for 3 days. On day 8 to 10, the supernatant of each well is removed by suction, then, each well is supplemented with the solution in a CellTiter-Glo™ Luminescent Cell Viability Assay kit and shaken for 30 minutes, and thereafter, the activity is measured with a TopCount NXT luminescence detection counter. The relative expression levels of the marker gene using real-time PCR and the activity values obtained from the test using the 3T3 cells are averaged and tallied for the solvent control group and every concentration of the test chemical, and thereafter, a relative value of each concentration is calculated using the average value of the solvent control group as 100%.

As the effects of a chemical on a mother animal, the 50% inhibitory concentration for cell growth ($IC_{50}$) is measured using, for example, differentiated cells such as 3T3 cells, and as the effects of the chemical on a fetus, the 50% inhibitory concentration for differentiation ($ID_{50}$) can be obtained as the concentration where 50% of the expression level of a marker gene is inhibited. When the chemical has $ID_{50} < IC_{50}$, the chemical is considered to have stronger effect on a fetus as compared to on a mother animal, and it can be assessed that the chemical has embryotoxicity. Also, when $ID_{50}>IC_{50}$, it can be assessed that embryotoxicity is not shown. According to the process described above, it is possible to assess embryotoxicity of a test chemical during the neural differentiation.

Example 18

A method for determining embryotoxicity of a test chemical according to the method of measuring the expression level of a marker gene in the neural differentiation process by flow cytometry or FACS will be described. First, a sample contacted with a test chemical is collected according to the following method. The ES cells cultured while maintaining an undifferentiated state are dispersed using 0.25% trypsin/1 mM EDTA. The cells are suspended in DMEM medium containing 15% heat inactivated fetal bovine serum, and thereafter, residual trypsin and serum are removed by centrifugation and suction of the supernatant, and the cells are suspended in neural differentiation medium comprising DMEM medium supplemented with 5% KSR (Invitrogen), 2 mM glutamine, 1 mM sodium pyruvate, 1 mM 2-mercaptoethanol, and a nonessential amino acid solution. The number of cells is counted using a small amount of the cell solution, and thereafter, the cell suspension is prepared to a cell density of $5 \times 10^5$ cells/mL. The prepared cell suspensions are added with only solvent such as PBS(−) or DMSO as a solvent control or added with a test chemical prepared by diluting with solvent into several levels, and thereafter, each cell suspension is seeded in a nonadherent U-bottom 96-well plate in a volume of 50 µl, and the culture is performed in an incubator at 37° C. and 5% $CO_2$ or an incubator at 37° C., 5% $CO_2$, and 5% $O_2$ for 3 days. On day 3 from the start of differentiation, 50 µL of neural differentiation medium is added, and the suspension culture is continued. The embryoid bodies formed in the nonadherent U-bottom 96-well plate are seeded in each well of a Poly-D-Lysine/Laminine-coated 96-well plate treated with fibronectin/PBS(−) solution prepared as 5 µg/mL, and the induction of neural differentiation is continued for further 5 days in an incubator at 37° C. and 5% $CO_2$ or an incubator at 37° C., 5% $CO_2$, and 5% $O_2$. On day 8 to 10 from differentiation induction, the cells in each well are collected and dispersed using trypsin/EDTA solution, and thereafter, the cells are immobilized with a paraformaldehyde solution. The cells are permeabilized with Saponin solution or the like, and thereafter, blocking is performed with normal goat serum. Antibody recognizing a gene product (protein) of each marker gene is added thereto, and the mixture is reacted for several hours and then washed 3 times or so. As the antibody, for example, anti-necdin antibody (Abcam pic.), anti-Cpe antibody (Santa Cruz Biotechnology, Inc.), anti-L1CAM antibody (Abcam pic.), anti-Pax6 antibody (Abcam pic.), and the like are used as a primary antibody. Also, a labeled secondary antibody such as a fluorescent substance or the like recognizing the primary antibody is reacted and then washed 3 times or so. In each sample obtained by the process described above, the positive cells expressing each marker gene product (hereinafter, marker gene product positive cells) are calculated by flow cytometry such as Epics Altra (Beckman Coulter).

In addition, using 3T3 cells obtained from ATCC, the effects of each test chemical on cell proliferation are evaluated. The 3T3 cells cultured in DMEM medium containing 10% heat inactivated fetal bovine serum, 2 mM glutamine, penicillin and streptomycin (medium for 3T3) in an incubator at 37° C. and 5% $CO_2$ are dispersed using 0.25% trypsin/1 mM EDTA, and thereafter, the cells are suspended in the medium for 3T3. Residual trypsin is removed by centrifugation and suction of the supernatant, and the cells are suspended in the medium for 3T3. Thereafter, the number of cells is counted using a small amount of the cell solution, and a cell suspension is prepared so as to have a cell number of 10,000 cells/mL. The prepared cell suspensions are added with only solvent such as PBS(−) or DMSO as a solvent control or added with a test chemical prepared by diluting with solvent into several levels, and thereafter, each cell suspension is seeded in a white 96-well plate for cell culture in a volume of 50 µL, and the culture is performed for 3 days. On day 3, 50 µL of the medium for 3T3 supplemented with the test chemical again prepared is added, and the culture is continued for 3 days. On day 8 to 10, the supernatant of each well is removed by suction, then, each well is supplemented with the solution in a CellTiter-Glo™ Luminescent Cell Viability Assay kit and shaken for 30 minutes, and thereafter, the activity is measured with a TopCount NXT luminescence detection counter. The number of the marker gene product positive cells using flow cytometry and the activity values obtained from the test using the 3T3 cells are averaged and tallied for the solvent control group and every concentration of the test chemical, and thereafter a relative value of each concentration is calculated using the average value of the solvent control group as 100%.

As the effects of a chemical on a mother animal, the 50% inhibitory concentration for cell growth ($IC_{50}$) is measured using, for example, differentiated cells such as 3T3 cells, and as the effects of the chemical on a fetus, the 50% inhibitory concentration for differentiation ($ID_{50}$) can be obtained as the concentration where 50% of the number of the marker gene product positive cells is inhibited. When the chemical has $ID_{50}<IC_{50}$, the chemical is considered to have stronger effect on a fetus as compared to on a mother animal, and it can be assessed that the chemical has embryotoxicity. Also, when $ID_{50}>IC_{50}$, it can be assessed that embryotoxicity is not shown. According to the process described above, it is possible to assess embryotoxicity of a test chemical during the neural differentiation.

INDUSTRIAL APPLICABILITY

According to the present invention, it becomes possible to provide a simple and versatile testing method for embryotoxicity of chemicals.

Free Text in Sequence Listing
SEQ ID NO:79
Designed oligonucleotide primer for PCR
SEQ ID NO:80
Designed oligonucleotide primer for PCR
SEQ ID NO:81
Designed oligonucleotide primer for PCR
SEQ ID NO:82
Designed oligonucleotide primer for PCR
SEQ ID NO:83
Designed oligonucleotide primer for PCR
SEQ ID NO:84
Designed oligonucleotide primer for PCR
SEQ ID NO:85
Designed oligonucleotide primer for PCR
SEQ ID NO:86
Designed oligonucleotide primer for PCR
SEQ ID NO:87
Designed oligonucleotide primer for PCR SEQ ID NO:88
Designed oligonucleotide primer for PCR
SEQ ID NO:89
Designed oligonucleotide primer for PCR
SEQ ID NO:90
Designed oligonucleotide primer for PCR
SEQ ID NO:91
Designed oligonucleotide primer for PCR
SEQ ID NO:92
Designed oligonucleotide primer for PCR
SEQ ID NO:93
Designed oligonucleotide primer for PCR
SEQ ID NO:94
Designed oligonucleotide primer for PCR
SEQ ID NO:95
Designed oligonucleotide primer for PCR
SEQ ID NO:96
Designed oligonucleotide primer for PCR
SEQ ID NO:97
Designed oligonucleotide primer for PCR
SEQ ID NO:98
Designed oligonucleotide primer for PCR
SEQ ID NO:99
Designed oligonucleotide primer for PCR
SEQ ID NO:100
Designed oligonucleotide primer for PCR
SEQ ID NO:231
Designed oligonucleotide primer for PCR
SEQ ID NO:232
Designed oligonucleotide primer for PCR
SEQ ID NO:233
Designed oligonucleotide primer for PCR
SEQ ID NO:234
Designed oligonucleotide primer for PCR
SEQ ID NO:235
Designed oligonucleotide primer for PCR
SEQ ID NO:236
Designed oligonucleotide primer for PCR
SEQ ID NO:237
Designed oligonucleotide primer for PCR
SEQ ID NO:238
Designed oligonucleotide primer for PCR

SEQUENCE LISTING (240 sequences)

SEQ ID NO: 1 - DNA, 1898 bp, Mus musculus
ttagaattgtgtggcgcttgctgagcataaaacttgggaccgccacccccttccctcctcctgccattggctccggctagaggttgacatcaaagccgaggccttatataagcaggatcctggtggcaagtccgcagaagggttaaacccggtctttggacgtctgaacccttctccctcgttgcctacagaaaccttcaagaggtcggcaggtccttcgtgtcatctccagccttgctcgctcaggactctccaaaccccagccagttcgctgcctctggagcccacggtgacccccttctgtggggcgcatggggcggtgctaattgggctgacagcacaggccaggagcctctccaacatgaacctcgtgggcagctacgcacatcatcaccatcatcaccactcacacccgccgcaccccatgctccacgaacccttcctgtttggcccggcctcgcgttgccaccaggagcggccttacttccagagctggctgctgagcccggctgatgctgccccagatttccctgccggcgggccaccacctaccaccgcagtagcagcggctgcctatggtcccgatgccaggccgagtcagagcccaggtcggctggaggctcttggaagccgcctgcccaaacgaaaaggctcaggacccaagaaggagaggagacgcacagagagcattaacagcgcgttcgcggagctgcgtgagtgcatccccaatgtgcccgccgacaccaagctctccaagatcaagactctgcgcctggctaccagttacatcgcctacttgatggacgtgctggccaaggatgcacaagcaggtgaccccgaggccttcaaggctgaactcaaaaagacggatggtggtcgcgaaagcaagcggaaaagggagttgcctcagcagcccgaaagcttccctcctgcctcggggcccggcgagaagaggattaaagggcgcaccggctggcctcagcaagtctgggcgctggagctaaaccagtgagaccaggccaacgccgccggagaacccggccgaggctggcccacctggctacgtggagaggagaggaaaggacgcagcggctacggcgggtctcccggtgcccgcgcgcgtttcgcccagtctctgcggagcaccggagggtcggcggttgcaactacccactaggatcgcacgtgcaatgtcatttgaatttgttaatacataagagaaagagaaatttttatatatgttcacttcccgccgagggcggctcttgaaggctcgactcaagatgggactggagaagaccaagcccccgaagacacacccttccaacccatctgggtggaactcaaccccaaaagccatggtcgcgccgctctctggctcgctctctcgtccccttcttggctctgcgtcagtaccctgatgccttctcgagttaaaatgcaataagagtaattggtagtttctaaccaggaagactgacgctgcctgggttgacctctcctgagcagcgatggttttccttcttgtcgctacacttcctacctagagggaaggcgttgctcccttgcgcagcacctctgctttccaagggaaatctttcccttcctttcccttcccttccctcccctctcctcctcctttcccctcttccgtcctcttacctcctctttctcttccttccttctccttcatttctttccttttccttctaaataaaagcgttcccattcgttgctgaatttgtaacgtatttaaactacctatcatgcctgttgctctcaggtatacatctccctacccccaccctctttctacctcaaatcagtgtgaccactcgcagccccaccctttgccaaagcagtatctatgctcttgacttaataaaaagttttcagag

SEQ ID NO: 2 - DNA, 1750 bp, Homo sapiens
gcggtcttatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttcttgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcaaaaaaaaaaaa

SEQ ID NO: 3 - DNA, 1186 bp, Pan troglodytes
ggggagtccgcagaagggttaaacaggtctttgggcatcggcgtcctcgcccgcggcagaaaccggcaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaacggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaagggctcaggacccaagaaggagcggagacgcacggagagcattaacagcgcattcgcggagctgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggtggatggcggccgtgagagcaagcggaaaagggagctgcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgatttttttaaatacattaagagaaagagaaatatatatatatccacccccagcccaaccgagggcggcccttggcggcaacatgcaagaaggagggactgtcgaacccaagggctcaaa

SEQ ID NO: 4 - DNA, 1521 bp, Canis lupus
atgtgtaaaaccctgcagctgtgcgatactgatgtagaattcgtgtgcctctaccgtgtgatgggagaggttgacatcaaagccgtggccttatataagccagaccctgcaggggaggccgcagaagggttaactaggtctgcggccccggcgtcccagcccgggacccaacaggcgagaggccggcgggcgcgcctgtccgcagcctcgccccacactctccccaagccggcgtccagcagagcgccgccccacagcccacgggtggcccgggcagtgtctggggcgcatggggcggcgctaaccgggctggcggcgcaggccaggggccgctccaacatgaacctcgtgggcagctacgcacaccatcaccaccatcaccaccatcaccacccacacccaacgcaccccatgctccacgaacccttcctcttcggcccggcgtcgcgctgtcaccaggagcggccctacttccagagctggctgctgagccccgcggacgctgccccagacttccccgccggcgggccaccgccctcagccgcggcggccaccgcagcctacgggcccgacgccaggcccggccagagccccgggcggctggaggcgctcggcggccgcctgggccggcggaaaggctcaggacccaagaaggagcggaggcgcacggagagcattaacagcgcgttcgcggagctgcgcgagtgcatccccaacgtgcccgccgacaccaagctctccaagatcaagaccctgcgcctggccaccagctacatcgcctatctgatggacgtgctggccaaggacgcacaggccggcgaccccgaagccttcaaggccgaactcaagaaggcggatggcggccgcgagagcaagcggaaaagggagctgcagcaacacgaaggctttcctcctgccctgggcccaggcgagaagaggattaaagggcgcacaggctggccgcagcaagtctgggcgctggagttaaaccagtgagccgaggccgcgccgaggacccgccacggctgcccgaccccggagccccgggaggagaggaaggcggcggcgagggccaggctctgggtgccaggggcttatgggggcgcatcccgcagagcctctgctgcgtgctggcaggtcgccagctgcaacaacacacttggatcgcacgtgcaatgtcatttgaaattgtttttaatacattaagagaaagagaaatatatatatatccaccccccacccctgaaactgagagggcggctcttggctgcacaatgcaggagagagggactgcgggactcaagcgcgctaaaacgcacccttccaacccttctggggcgaatttcgaagcccctatgctttctccactatgcctactggctcttttcttgtcctccccgaccgctttgcggcaaaacccccgggcgctctcttccctaatgaaaatgcaataagaggaatcaatagtttttgccagggaaagagaaccaaaccaggaagacggagggctgccttttgttg

SEQ ID NO: 5 - DNA, 1102 bp, Rattus norvegicus
cccgctctttggaaatccgaacccttctctctcgctgcctacagaaaccttcaagaagtccgcaggtccttcgtgtcatctccagccttgctcaggactcctccaaaacccagccaattcgctgcattggagcccacggtgacccccttctgtggggcgcatggggcggtgctaattgggctggcagcacaggccaggaggctctccaacatgaacctcgtgggcagctacgcacaccatcaccaccatcaccactcacacccgccgcaccccatgctgcacgaacccttcctctttggtccggcctcgcgttgccaccaggagcggccttacttccagagctggctgctgagcccggctgatgctgccccagatttccctgccggcgggccaccacctaccaccgcagtagcagcggctgcctatggtcccgatgccaggccgagtcagagcccaggtcggctggaggctcttggaggccgcctgcccaggcgaaaaggttcaggacccaaaaaggagcggaggcgcacagagagcattaacagtgcgttcgcggagctgcgtgagtgcatccccaatgtgcctgcggacaccaagctctccaagatcaagactctgcgcctggccaccagctacatcgcctacttgatggacgtgctggccaaggatgcacaagcaggtgaccccgaggccttcaaggctgaactaaaaaagacggatggcggtcgcgaaagcaagcggaaaagggagtcgcctcagcagcacgaaggccttcctcctgccctggggccaagcgagaagaggattaaaggacgcactggctggcctcagcaagtctgggcgctggagctaaatcagtgagaagaggccggcaccgaggacccggccaaggctggcccacctggctatccggagaggagagggcaggacgcagcggccacggcaagtctccgggtacccgcgcgcgtcttgcccagtctctgcgagcgccggcgggtcggcggttgcaactacccactagaatcgcacgtgcaatgtcatttgaatttgttaatacataagagaaagagaaaaaaaaaaaaaaaaaaaaaaaaaaaaaaaa

SEQ ID NO: 6 - DNA, 6388 bp, Mus musculus
gcgtctgggatgtgggctgggtggcttttaggccggcgtttgcttgaaaacctccgccgccgctaggccgggggcaggcaatggcaggggatgtgtgattgcggacagtgagagggccgttgctatcatgcccgggcgcgcgggcgtcgcccggttctgcttgctggctctcgctctgcagctacattggccgctggcggcgtgcgagccgggatggaccacaagaggaagccaagaaggtagccctccgctacagcatgaactcataatacctcagtggcggacttcagaaagccctgggagaggaaagcatccactcagagcagagctcagggtcatggctgaagggcgagagctgatcctagacctggagaagaacgagcacctttttgctccagcctacacagaaacctgctacactgcaagtggcaatcctcaaaccagcacgctgaagtctgaggatcactgcttttaccacgggactgtgagggacgtggatgagtccagtgtcacgctcagcacctgccggggaattagaggactgattatagtgagaagtaacctcagctacatcatcgagcccgtccctaacagcgacagccaacaccgtatttacagatccgaacatctcacgctgcccccggggaactgtgggttcgagcactccgggcccacctcgaaggactgggcccttcagtttacacatcagaccaaaaagcaacctcgcagaatgaaacgggaagatctacactctatgaagtacgtggagctttacctggtggctgattatgcagagtttcagaagaatcgacatgaccaggatgccaccaaacgcaagctcatggagattgccaactatgttgataagttttaccgctccctgaacatccgaattgcacttgtcggcttggaggtgtggacgcatggggataagtgtgaagtttcagagaatccctactctaccctctggtcctttcttagttggaggcgcaagctgcttgctcagaagagccatgacaatgctcagctaatcacgggcaggtccttccaaggcaccaccattggcctggcccccctcatggccatgtgctccgtgtaccagtctggaggagttagcatggaccactccgagaatgccattggtgtagcctccactgtggcccatgagattggccacaactttggcatgagccatgattctgcacactgctgttctgccagtgcagccgatggcggctgcatcatggccgccgccaccgggcaccctttccccaaagtgttcagttggtgtaacaggaaggagctggacaggtatctgcagacaggaggagggatgtgtctctccaacatgccggacactaggacgctgtatggaggccggaggtgtggcaacgggtacctggaagacggtgaagaatgtgactgtggagaagaggaggaatgtaagaacccttgctgcaatgcctccaactgcactctgaaggaaggggcagagtgtgcccatggttcctgctgccaccagtgcaagctggtggctcctggaacccagtgtcgggagcaggttcggcaatgtgacctccccgagttctgcaccggcaagtctccccactgccccaccaactattatcagatggatggcaccccctgcgagggtggccaggcctactgctacaacggcatgtgcctcacttaccaggaacagtgccagcagctgtggggacctggagcccggcctgccctcgatctttgctttgagagggtgaatgctgctggtgacacctatggaaactgtggcaagggcttgaatggccaatacaggaagtgcagtcccagggatgccaagtgtgggaagattcagtgccagagcacccaggcccggcccctggaatccaacgcagtatctattgacaccaccatcaccttgaacgggaggcggatccactgtcggggcacccacgtctaccggggtcctgaggaggaggaaggggaaggtgacatgctggacccagggctggtgatgactggaaccaagtgtggccacaaccatatttgcttcgaggggcagtgcaggaacacctccttctttgagacggaaggctgtgggaaaaagtgcaatggccacggggtctgcaacaacaacaagaactgtcattgcttccctggctggtctccacctttctgtaacaccccgggagatggtggcagcgtcgacagtggtcctttgccccctaagagtgtgggtcccgtgatcgctggggtgttttcagctctcttcgtgttggcagttctggtgctactgtgtcactgctacagacagagccacaaactgggcaaaccctcggctctccctttcaagctgcggcatcagttcagttgtcccttcagggtatctcagagtggtggaactggccatgccaacccaactttcaagttgcagaccccccagggcaagcgaaaggtgactaacacccctgaatccctccggaagccgtcccacccccctccccggccccctccagactacctgcgcgttgaatcgccacctgcaccattgccggcacatctgaacagggctgctgggagctccccagaagctggggctcgaatagaaagaaaggagtcagccaggaggcctcccccaagccgacccatgccccctgcacctaactgcctactgtcccaggacttctccaggcctcgaccacctcagaaggcactcccagccaatccggtgccaggccaaaggaccggtcccaggtcaggaggcacctccctgcttcagccccctacttctggtcctcagccccccaggcctccagcagtgcctgttccaaagctacccgagtaccgatcacagagggttggagcaataattagctccaagatctagaagtgtcgagaagtttcttgttccgatggaagactccggatgccatggaaggtccagaagaaagacgccttctcacccatcctgaagctttggcagccttctggaacgtccctcatccccagaatctcccttcttacccgagtgcctcctgcttcctccgaggcccagggggactcatatccaatggctcctaagtgtttgtcctgtgcaatatacagcccagggagggaagggaagcacggcgaggagggtgggaaaggttctccctcagcccactagccaagagctaccagcgatgctcagggaaggcttgagctggggtcctcctctgcggagcttggagaaggtacccatcctggtcctatgctggcaggaacacacgcgagtgtcactgattggcctccttctgggatcccaggctgctgaggaagctactgctacatccctaccccaaggggcttggtcaaggtgcctgttcctggctctctggctgcatgtgataagccatgctcccctcccctgcctttcttcacattcccactcccatatttacacgggtcactctgactcagacaggtactatttgtaagtagcatagacagcaggggggtggggtggtcaacctgtgtcccctctgagccgttatgccaaaggtcactaaggacatttagaatccccatccatccatccatccatccatccatccatccattcatccatccccagtgttccatgtgtcaccttctccttttccagcatccctatcctatggtgctttggtggtgaactatggcagtcctgacttgctgatgaccatatgctggtgacctacaaatcgggatcctgccatatggggtcgccactggactttctgcactggatctcaagagcgttgagccgagtgggcgtgtatgtgtgtgtgtgtgtgtgtgtgtgtgtgtgtgtgtgtgtgtgtgtgtgtgtgaaagagacagaggcaatgagagagacagacatgcaggcaggccgacagctctgcatgtacttgtgttttacggcctcaagcagaataagggacctcctccttatttctgactcatatctaagtaaggttccccaggacagccacagttgtactgaggggggctgacatgtttggcatcctggctatagtattgtatacacagggccaccagccccgccctagtggtcagctctgaggggggactggtgactctgaacagatcgatgtcaacagccatggtgaaccagatctgggcagggttccccaaactctattcaaccagagttttatcacgcacctcatcgggtctctcctggttgctgccccgaggtgatcgtcatggaaaatgctgagaaggtgggaatgggatggggtggaccttctcttgcttggtgctccgctatttggaacagttcttacacatttgctgggcctggcctctgagaggccatcttccacccccagaaaggtgctaatggcactgcagagggctctctaggggcctccccgccccaacagcaagcagttgttagctcttggaaccctccagaggaagaggcaagcgtttgacttcccctttaccacctgaggcctccttatatctcttcccagagtaagctttgggattgtagacatgtgggagctatgacagacgtggcctggggtagaaagatctcaggaaagcacctttctccttttcagggtgaccgtgctcttcacactctctgaggcctcagtccatgtcctatatcagtttctcttttgtgtgctttaccaagtggccggtgactacaggccaccccgattctcaccacaaagttagaaaccctccactttctgtcccttgaaccatatcagaaaaagacccatttccttgctctttggtaatcacttctgtttttttctttttcattactttgctaccacctccatcccatgacattatactgtgaagtgtaagaggacggggtttttttaaacttggtagaaatgtcggcagctgctctacacacaacttcactcaaggctttgtttccagaggccagctaggctgtcacaggcaggaatcccttcccatctgctttgtgaagggtcccatacaggtgtatctagacttcaaggacagggtttgtctcacaggattgtcacttaggagatgaaagaatattaccacatgaggaggaggggcagttgcaacagaacactttggtcttcctacaccaagtctgtgagggcatccaagactgaatgaaagcgcttttcttatgcatacaatgtgagcaagaacaagaactgtttaaggcacctctgttcccagccactgaagagagacgtcagaagatgttagaataggtcaaagccaaggctctggtgggctgagggaaggtttgtagctgcgtttagtggtatacatctttagtcccagcataggcaggtgaatctcgagtttgaagctagcctggtctaaaaaggaagttccaagactgccagggccacacagaggaaaaaaaaaaccctctagaaaaacaaaaatgaagacaggatctcatgtatcgtagattggcctttaagtcactttaccaaggatgatctttgaactcctgagtacagactgcgggtgtgtgctaccatgctttatgtggccctgggttcaaacacagcccttcatatgtatatagccaaacactctacaactgagctacatcctccagcctaggctgtaaatgttttttggagctagattagctgcctgccaaccttagaactgcaaagccattcctgacctgtaaacctcagctctccatctctataagaggtatagcctgggctaataccgtccaagttacaactccttgcttgctttctgttccttctagccttggtgacttccaccaggaagagaataccccctctctacccctgctccaagacactgtagatgctagtgtcggagtgttctctgtaacgcgacagttccttctgttgcaatagcccccctgcaacactgcaataatccttcagtgtctcccctgggctcaattcacttccttatttgacaaagtggaggtgagacttgtattcttaaaattggaggctagttattttgtcaaatgcatgtaatgaacagacccgaaggaatcctccacacacaagccagggaacaccaactggaaaggtaccccgtcccagggaagcctgctagggagaggttctgtagaatccgagcctagcaccccaaagtcatgcacccagtatcctcttgtatgactgtatatgtctatgtctgggatccagggcaaatgtgaattttcttttgatttgggagattgttcacaggaagtagtcctcccctctcatgtcctcctattgattgtttacaatatttgtacatctatgcaaaatacttgaatgggccatggtgccttgttttttgttgttgttgttatttttttctccttgtttgtatttaattaaaacaaattgtcatgaggaaa

SEQ ID NO: 7 - DNA, 3127 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagtaaaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagt

SEQ ID NO: 8 - DNA, 6466 bp, Homo sapiens
gccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 9 - DNA, 3214 bp, Pan troglodytes
agacgcgcctccaccgccgggcagggggcaggtatggctgagggcgtgtgagcgccgagcgctaagggccgccgccaccatgccagggggcgcaggcgccgcccggctctgcttgctggcgtttgccctgcagctcctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaatcggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccatgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcggattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcatggctcctgctgccaccagtgtaagctgttggctcctgggaccctgtgccgcgagcaggccaggcagtgtgacctcccagagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgcttcgaggggcagtgcaggaacacctccttctttgaaactgaaggctgtgggaagaagtgcaatggccatggggtctgtaacaacaaccagaactgccactgcctgccgggctgggcccctcccttctgcaacacaccgggccacgggggcagtatcgacagtgggcctatgccccctgagagtgtgggtcctgtggtagctggagtgttggtggccatcttggtgctggcggtcctcacgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagaccccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagttgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagaaggtatggaagacttgcaatttgaaaactggggaccagttccaaagtcagtaattttgttaaccacgtgtataacagctgtgctggacacccaagaaagccatgggaacgccaactggaaaggtccccttcccgaggggagcctgtgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 10 - DNA, 7193 bp, Pan troglodytes
atgccagggggcgcaggcgccgcccggctctgcttgctggcgtttgccctgcagctcctccggccgcgggcggcgcgggagcctggatggacaagtaaaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaatcggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccatgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcggattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcatggctcctgctgccaccagtgtaagctgttggctcctgggaccctgtgccgcgagcaggccaggcagtgtgacctcccagagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgcttcgaggggcagtgcaggaacacctccttctttgaaactgaaggctgtgggaagaagtgcaatggccatggggtctgtaacaacaaccagaactgccactgcctgccgggctgggcccctcccttctgcaacacaccgggccacgggggcagtatcgacagtgggcctatgccccctgagagtgtgggtcctgtggtagctggagtgttggtggccatcttggtgctggcggtcctcacgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagaccccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagttgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacaggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttctttgtgcccgcttgactgtggagttttggcttcgtgtgaaaggtgattcttagaatcctgagctgtggtggcttcagtcctgcccctgcacctgacctggggagggaccctgagcaagtccctcttgagtctgtttcctcatttgtacagaggctatgatgagcagcagtaccagccccatcaggttgttgtggagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactgtggactgtgctgctgccttagcagggaagggaagagggaggggtggctggtcagcttcagataggggcacctaccacaccccttcctgctgggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactacgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccaggcttgggcttcctctgagctgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatgcccactggggtcatatgtttatttttcattgtgttttgtgacctcagcagggtgggggtcttcctccttactctgagctaaatctaggtgaggtccccccttagggagcccagctatttacaaagtacacacgagggagccagcctgccctagtggctggtcattgacctcgggctggaccgttgccctctgagcagagaacagacccatttctaggagctgcccgagatcactggagaaggcagccagcaacagctgcactggaacagtcagagctgggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggatggccatgtggtgctttgctagataggacggtttttgcaaagcacctggagatgttttctgggagatagactcccactccacaaaggtgctgggtggctctccggacaggagctggcctgactctcactcctctgaggctttcctggggcctcctcccatcctgccatgagcaattgttcgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaagtgacagcgccacagccatagtgactgcatgagccatctgaacctgcagtccaccctccctggaaccacaccagaaagagacctgggttgttgttttcttgctttttgttttgttttgttttattattttcatatcacctccatcccataaagttgtactgtgaactggaagatggtggaatgttttggaatttgatagacttttggcaaccagttctactaatgcttcactcctggctttgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatagctagaaagaaccacgttcagggaatgactttgtgcccagcctttttttttttttttttttttccaggggaggggctgtttgctggctcaggctgagggtggcccaaagtccagggtctggtggggaggagggaagcttaactcaagtttgggttagtgagttagcaagctctttgtgcagatggggatgtaggtaaatctttttgaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcccttttctgccccagctctgagacacttgcagatcttaaggtctgagacttgctgattttctggttggagtgtttttttgtattgccatagtcccttccccctgaagcaatagcccctccccacctcctgcaatacccctttccaataaagtctctccctgcctacttcctaatttattcttatttgacagaaggtatggaagacttgcaatttgaaaactggggaccagttccaaagtcagtaattttgttaaccacgtgtataacagctgtgctggacacccaagaaagccatgggaacgccaactggaaaggtccccttcccgaggggagcctgtgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttat

SEQ ID NO: 11 - DNA, 6481 bp, Pan troglodytes
agacgcgcctccaccgccgggcagggggcaggtatggctgagggcgtgtgagcgccgagcgctaagggccgccgccaccatgccagggggcgcaggcgccgcccggctctgcttgctggcgtttgccctgcagctcctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaatcggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccatgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcggattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcatggctcctgctgccaccagtgtaagctgttggctcctgggaccctgtgccgcgagcaggccaggcagtgtgacctcccagagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgcttcgaggggcagtgcaggaacacctccttctttgaaactgaaggctgtgggaagaagtgcaatggccatggggtctgtaacaacaaccagaactgccactgcctgccgggctgggcccctcccttctgcaacacaccgggccacgggggcagtatcgacagtgggcctatgccccctgagagtgtgggtcctgtggtagctggagtgttggtggccatcttggtgctggcggtcctcacgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagaccccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagttgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactacgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccaggcttgggcttcctctgagctgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatgcccactggggtcatatgtttatttttcattgtgttttgtgacctcagcagggtgggggtcttcctccttactctgagctaaatctaggtgaggtccccccttagggagcccagctatttacaaagtacacacgagggagccagcctgccctagtggctggtcattgacctcgggctggaccgttgccctctgagcagagaacagacccatttctaggagctgcccgagatcactggagaaggcagccagcaacagctgcactggaacagtcagagctgggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggatggccatgtggtgctttgctagataggacggtttttgcaaagcacctggagatgttttctgggagatagactcccactccacaaaggtgctgggtggctctccggacaggagctggcctgactctcactcctctgaggctttcctggggcctcctcccatcctgccatgagcaattgttcgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaagtgacagcgccacagccatagtgactgcatgagccatctgaacctgcagtccaccctccctggaaccacaccagaaagagacctgggttgttgttttcttgctttttgttttgttttgttttattattttcatatcacctccatcccataaagttgtactgtgaactggaagatggtggaatgttttggaatttgatagacttttggcaaccagttctactaatgcttcactcctggctttgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatagctagaaagaaccacgttcagggaatgactttgtgcccagcctttttttttttttttttttttccaggggaggggctgtttgctggctcaggctgagggtggcccaaagtccagggtctggtggggaggagggaagcttaactcaagtttgggttagtgagttagcaagctctttgtgcagatggggatgtaggtaaatctttttgaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcccttttctgccccagctctgagacacttgcagatcttaaggtctgagacttgctgattttctggttggagtgtttttttgtattgccatagtcccttccccctgaagcaatagcccctccccacctcctgcaatacccctttccaataaagtctctccctgcctacttcctaatttattcttatttgacagaaggtatggaagacttgcaatttgaaaactggggaccagttccaaagtcagtaattttgttaaccacgtgtataacagctgtgctggacacccaagaaagccatgggaacgccaactggaaaggtccccttcccgaggggagcctgtgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttat

SEQ ID NO: 12 - DNA, 7269 bp, Pan troglodytes
agacgcgcctccaccgccgggcagggggcaggtatggctgagggcgtgtgagcgccgagcgctaagggccgccgccaccatgccagggggcgcaggcgccgcccggctctgcttgctggcgtttgccctgcagctcctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaatcggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccatgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcggattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcatggctcctgctgccaccagtgtaagctgttggctcctgggaccctgtgccgcgagcaggccaggcagtgtgacctcccagagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgcttcgaggggcagtgcaggaacacctccttctttgaaactgaaggctgtgggaagaagtgcaatggccatggggtctgtaacaacaaccagaactgccactgcctgccgggctgggcccctcccttctgcaacacaccgggccacgggggcagtatcgacagtgggcctatgccccctgagagtgtgggtcctgtggtagctggagtgttggtggccatcttggtgctggcggtcctcacgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagaccccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagttgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacaggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttctttgtgcccgcttgactgtggagttttggcttcgtgtgaaaggtgattcttagaatcctgagctgtggtggcttcagtcctgcccctgcacctgacctggggagggaccctgagcaagtccctcttgagtctgtttcctcatttgtacagaggctatgatgagcagcagtaccagccccatcaggttgttgtggagagcaaggaagtgcattagtagaagccacctggcctgcgggaggctgtgtacacttggcccctcctcgtacttcttctgtgtggctgacagtctcagtttgccagtcttggcagtcaggtcagaaagggatgaggtgaagaagctggctgaccatgctgtattcccacgaggcattgagaaaactgtggactgtgctgctgccttagcagggaagggaagagggaggggtggctggtcagcttcagataggggcacctaccacaccccttcctgctgggctgatggtctgggtgagtggacacatggatggacttcacaagaagcctttgttctcagtgggtggtccatccttccttctaaaatcgggaggatggctgcccccttgatcccattgatcagcatcaagctgatgtctctctccctcccttctttttcttcccagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactacgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccaggcttgggcttcctctgagctgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatgcccactggggtcatatgtttatttttcattgtgttttgtgacctcagcagggtgggggtcttcctccttactctgagctaaatctaggtgaggtccccccttagggagcccagctatttacaaagtacacacgagggagccagcctgccctagtggctggtcattgacctcgggctggaccgttgccctctgagcagagaacagacccatttctaggagctgcccgagatcactggagaaggcagccagcaacagctgcactggaacagtcagagctgggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggatggccatgtggtgctttgctagataggacggtttttgcaaagcacctggagatgttttctgggagatagactcccactccacaaaggtgctgggtggctctccggacaggagctggcctgactctcactcctctgaggctttcctggggcctcctcccatcctgccatgagcaattgttcgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaagtgacagcgccacagccatagtgactgcatgagccatctgaacctgcagtccaccctccctggaaccacaccagaaagagacctgggttgttgttttcttgctttttgttttgttttgttttattattttcatatcacctccatcccataaagttgtactgtgaactggaagatggtggaatgttttggaatttgatagacttttggcaaccagttctactaatgcttcactcctggctttgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatagctagaaagaaccacgttcagggaatgactttgtgcccagcctttttttttttttttttttttccaggggaggggctgtttgctggctcaggctgagggtggcccaaagtccagggtctggtggggaggagggaagcttaactcaagtttgggttagtgagttagcaagctctttgtgcagatggggatgtaggtaaatctttttgaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcccttttctgccccagctctgagacacttgcagatcttaaggtctgagacttgctgattttctggttggagtgtttttttgtattgccatagtcccttccccctgaagcaatagcccctccccacctcctgcaatacccctttccaataaagtctctccctgcctacttcctaatttattcttatttgacagaaggtatggaagacttgcaatttgaaaactggggaccagttccaaagtcagtaattttgttaaccacgtgtataacagctgtgctggacacccaagaaagccatgggaacgccaactggaaaggtccccttcccgaggggagcctgtgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttat

SEQ ID NO: 13 - DNA, 2730 bp, Canis lupus
atggcccggggcgcgggcgccgtccggctctgcctgctggcgctcgccctgcccgggtggaccacaagaggaaatggggaaggcagccccctgctccagcatgaacgaataatacctcagtggaagacggcagaaagccccacgaaagaaaagcatccactcaaagctgaactcaggataacagccgaggggcaagagctgatcctggacttggaaaagaatgagcacctttttgctccagcctacacagaaacccattatactccacatggcaaccctcaaaccactatgctgaaatctgaggaacactgcttttatcacgggacggtgaggaaggcagaacagtccagtgtggcgctcagcacctgccggggaatgagaggactgattacggtgagcagtaacctcagctacatcatcgagcccctccccgacagcgagggccaccaccttatttacagatctgaacatctcaagctgcccctggggaactgtgggttcaagtactccaagtccatcactggggacagggtccttccttctatgaaccagaccaagaaacgacctcgcaggatgaaaagggaagatttacactccatgaagtatgtggagctttacctcgtggctgattatgcagagtttcagaagaatcggcgagaccaggacgccaccaaacacaagctcatggagatcgccaattacgttgataagttttaccgatccttgaacatccggattgccctcgtgggcttggaagtatggactcacgggaatatgtgtgaagtttccgagaacccctactctactctatggtcatttctcagttggaggcgcaagctgctcacccagaagaaccatgacaacgcacagttaatcacgggcatgtctttccatggcaccaccatcgggctggcccccctcatggccatgaactccgtgtaccagtctggaggagtcaacatggaccactctgagaatgccattggtgtggctgccaccatggcccatgagatgggccacaacttcggcatgagccacgattctgcagaatgctgctcagccagcgcagctgatggcgggtgcatcatggcagctgccactgggcatccctttccaagagtgttcaatggatgcaacaggaaggagctggacaggtatctgcagtcaggcggtgggatgtgtctctccaacatgccagacaccaggacgctgtatggaggccggaggtgtggaaacggttacctggaagatggggaagaatgtgactgtggggaggaagaggaatgtaataacccgtgctgcaatgcctccaactgcaccctgagagaaggggcggaatgtgcccatggagcctgctgtcaccagtgtaagctgctggcccctgggaccctgtgccgtgagcaggcacggcagtgtgacctcccagaattctgcacgggcaagtctccccattgccccaccaacttctaccagatggacggcaccccctgtgagggtggccaggcctactgctacaatggcatgtgcctcacctaccaggaacagtgccagcagctctggggtcctggagcccggcctgctcctgatctctgctttgagaaggtgaatgtggccggggatacctttggaaactgtgggaaagacatgaatggggaacacaagaaatgcaacatgagagatgccaagtgtgggaagatccagtgtcagagttctgaggcccggcccctggaatccaacgcagtgcccattgacaccaccatcatcttgaatggaaggcagatccgatgccgaggtacccatgtctaccgtggtcccgaggaagagggtgacatgctggacccaggcctggtgatgaccgggaccaagtgtggctacaaccacatttgcttcgaggggcagtgcaggaacacctcgttcttcgaaacagaaggctgtgggaagaagtgcaatggccatggggtctgcaacaacaaccagaactgccactgcttccagggctgggccccgcccttctgcaacacgcccggccaggggggcagcatcgacagtggacccatgccctccgacagtgttggtcctatgatagctggagtgttcacggccgtatttgtgctggcagtccttatgctgatatactgctgctgtaaacagaacaacaaactgggccaactcaagcccttggcgctcccttccaaactgaggcaacagttcagctgtcccttcagggtgtctcagaacagtggaactggccacgccaacccaacgtttaagttgcagacgccccagggcaagcgaaaggtgaccaacacccccgaaaccccgcggaagccctcccagcctcctcctcggccccctccagactatctgcacggcgggtcgccacctgcaccactgccagcgcacctcagcagagctgctaggaactccccaggggcagggccccaagtagagaggagggagtcatccaggaggccgcctcccagccggccagtgccccctgcaccaaactgcatcctctcccaggatttctccaggccacggccaccgcagaaagcactccccgctaacccggtgccaggccgcaagagcctccccaggccaggtggcacctccatcctgcagcccaccgccaccactcctctgcagccccggcctctggcagcacctgtcccaaagtttcctgaatacagaccacagagggctggggggatgattggctcgaagatatag

SEQ ID NO: 14 - DNA, 2906 bp, Rattus norvegicus
tgggctgtgggctgggtggcttttaggccagcgtttgcttgaaaaccgccgccgccgctaggccgggggcaggcaatggcaggggatgtgtgattgcggacagtgagagggccattgctatcatgcccgggcgcgcgggcgtcgcccggttctgcttgctggctctcgctctgcagctacagtggccgctggcggcatgcgaaccggaatggaccacaagaggaagcaaagaagacagccctccactacaacatgaactcataatacctcagtggaggacttcagaaagccccaggggaggaaagcatccactcacggcagagctcagggtcatggctgaagggcgagagctgatcctggacctggagaagaacgagcacctttttgctccagcctacacagagacctgctacaccgcaagtggcaatcctcagaccaccacgctgaaatctgaggatcactgcttttaccacgggactgtgaggaaagtggatgagtccagcgtcactctcagcacctgccggggaattagaggactgattatagtgagaagtaacctcagctacatcatcgagcccgtccctaacagcgacaaccaacaccgtatttacagatccgaacatctcaagctgcccccggggaactgtgggttcgagcactccaggcccacctctaaggactggacccttcagtttacacatcagaccaaaaagcaacctcgcagaatgaaacgggaagatttacactctatgaagtacgtggagctttatctggtggctgattacgcagagtttcagaagaaccggcatgaccaggatgccaccaaacacaagctcatggagattgccaactatgttgataagttttaccgctccctgagcatccggattgcgcttgtcggcttggaggtgtggacacacggggataagtgtgaagtctcagagaatccgtactctaccctctggtcctttctcagttggaggcgcaagctgctcacccagaagagccatgacaatgcccagctaatcacgggcaggtccttccaaggcaccaccattggcctggcccccctcatggccatgtgttctgtgtaccagtccggaggagttagcatggaccactccgagaatgccatcggtgtagcctccaccgtggcccacgagattggccacaactttggcatgagccatgattctgcacactgctgttctaccagcgcagccgatggtgggtgcatcatggctgctgctacggggcaccctttccccaaagtgttcagttcgtgcaacaggaaggagctggacaggtatctgcagtcaggaggtgggatgtgtctctccaacatgccagatacgaggactctgtatggaggccggaggtgtggcaatgggtacctggaagacggtgaagaatgtgactgcggagaagaggacgaatgtaagaacccttgctgcaatgcctccaactgcactctgaaggaaggggccgagtgtgcccatggctcctgctgccaccagtgtaagctggtggctcctggaacccagtgtcgtgagcaggtgcggcagtgtgatctccccgagttctgcacgggcaagtccccccactgccccaccaactattaccagatggatggcaccccctgcgagggtggccaggcctactgctacaatggcatgtgcctcacttatcaggagcagtgccagcagctgtggggacctggagccaggcctgctcttgatctttgcttcgagagggtgaatgctgctggtgacacctatggtaactgcggcaaaggcttgaatggcaaatacaggaagtgcagccccagggatgccaagtgtgggaagatccagtgtcagagcacccaggccaggcccctggaatccaacgcagtatctattgacaccaccattaccttgaacgggaggcggatccactgtcggggcacccatgtctaccggggtcctgaggaggaagaaggggagggtgacatgctggacccagggctggtgatgaccgggaccaagtgtggccacaaccatatttgcttcgaggggcaatgcaggaacacctccttctttgagacggaaggctgtgggaaaaagtgcaatggtcatggggtctgcaacaacaacaagaactgtcattgcttccctggctgggctccacctttctgtaacaccccaggagatggcggcagcattgacagtgggcctttgccccctaagagtgcgggtcctgtgattgctggggtgttttctgccctcttcgtgttggcagtcctggtgctattgtgtcattgctacagacagagccacaaactgggcaagccctcagctctcccttttaagctgcggcaacagttcagttgtcccttcagggtgtctcagaatggtggaactggccacgccaacccaactttcaagttgcagacaccccagggcaagcgaaaggtgactaacacccctgaaactctccggaagccctcccaccctcctccccggccccctccggactacctacgagttgaatcccatcctgcaccactgccagcacatctgaacagggctgctgggagctcaccagaagctggagctcagatagaaagaaaggaatcagccagaagacctcccccaagccggcccatgccccctgcaccgaactgcctactgtcccaggatttctccaggcctcgaccacctcagaaggcactcccagcgaatcctgtgccgggccaaaggactgttcccaggccaggaggcacctccctgtttcatccccctactactggtcctcagcctcccaggcctccagcagtgtctgttccaaaggtgagtccgcggaaggaccagaggagaagcgtgtggctgagaaagcagtttctgtgctctcgtggtctaaactga

SEQ ID NO: 15 - DNA, 5551 bp, Mus musculus
atggctgatgcccagatgcaggtagctcctacaccaaccatccaaatgaggacagaagaggacctgtccctccctcatccctcagccccagagggtctgccgccaccaccccccaaagaaaccttctccaagttccagcagcagcggcaagccagtgagctccggcgtctctacaaacacatccaccctgagcttcggaagaacctcgaggaggctgtggctgaggacctggcggaggtcctcggttcggaggagcccactgagggcgatgttcagtgtatgcgctggatctttgagaactggcggctagatgccattggcgatcacgagaggccggctgccagggaacctgtgtcaggtggcaacgtccaggccacctctcgaaagtttgaggaaggctcctttaccaacagctcagatcaggagccggagggactccggccatcagggggtgatgtccaagctgccagacagatgtttgagaccaagccactggatgcgctgagaggccaggaggaggcaacacagacaaccatgagggaacctgcagccactggagatgtacagggaaccagaaagctctttgagactaggcccctggaccgactgggctcccgcccctctatccaggagcagagtcctttagagctgcgctcagagattcaggagctgaagggcgatgtgaagaagacggtgaagctgtttcagacggaacctctatgcgccatccaggatgccgagggcaccatccacgaagtcaaggctgcctgtcgggaggagattcaaagcaatgcagtgaggtctgctcgctggctctttgagacccgacctctggatgccttcaaccaggaccccagccaggtgcgggtgattcgggggatctcccttgaggagggagccctgccggatgtcagtgcaactcgttggatctttgagacgcagcctttggatgccattcgtgagatcgaggtggacgagaaggacttccagccatctccggatctcatccctcctggcccagatgttcagcatcagcgacatctgtttgaaacctgttccctggacactctgaagggtgaaagagaaacagaggcagaggtgccacccaaggaggaggtgattcctggcgatgtccgctctacactctggctatttgaaacaaaacccctggatgctttcagagaccaggtccaagtgggtcacctgcaacgggtgggtcaccaggagggtgaggggcttgtgacagagtgtctacccagtaatggtacttcggtgttgcctctgtctcagggtgtcccccagaatgatgggttgaaaggggatgtgaaaaccttcaagaatctttttgagacccttcccttagacagcattgggcagggtgagccttcagcctatgggaacataaacagaggacaaaacactgattctgccgagcagtcccagggttctgacgccccggtatatgctatgcaggacagcaggggacagcttcatgccctgacttctgtcagcagagagcaggtagttggaggtgatgttcagggctacaagtggatgtttgagacacagcccctggacacgctgggtagaagccccagtaccatcgatgtggtacgaggtatcactcggcaggaagtggtggctggggatgtcggcaccactcggtggctctttgagacgcagccattggagatgatccaccaacaagagcaacagaaaccagaggaggaagaggggaagggtccaggaggccccccccctgagctccccaaaaagggtgatgtacagactatccgttggctgtttgagacctaccctatgagcgagttggcagagaagcgagaatctgaggtcacagaccccgtgagcaaggctgagacacagtcctgcacctggatgtttgggccccaatctctgaacccagcagaaggctctggggagcagcacctgcaaaccagccaggttccggctggagacaggcagacagacagacatgtctttgagactgaatctctgccagcctcaaaccaatccagtgggagaaagcctgtaaggtactgcagccgggtggagattccttccgggcaggtatctcggcagaaagaggttttccaggccctggaggcgggcaagaaggaggtcccggagaccacaatcaacctggggtccatccccacaggctctgtgcataaattcacctggctctttgaaaactgtcccatgggctccctggcagctgagagcatcagaggggacaacctccaggaagaacagccaaaaggctctgcaggccatgggacaccagagaggcaggagacagcagccgagagaacccttcggactttgcatgccacccccggcatcctgcaccatggaggcatcctcatggaggcccgagggccaggggagctctgtcttgccaagtatgtgctcccaagcccagggcaggggcgcccctacatacggaaggaggagctggtgtgtggtgagcttcccaggatcgtccgtcaagtgctgcgccggacagacgtggaccagcagggactgctggttcaggaggacacagctgggcagctccagctccacccactcacgctgccagggcctggtgaccctgggaatattgaagacatggaccctgagctccagcagctgctggcctgtggcctgggagtctctgtgtcaaagacggggctggtgatgcaagagacaggacagggcctagtggcactgactgcctactccctccagccccagcttaccagcagggcccctgaaagaagcagtgtgcagctgctggccagctgcatagacaaaggagacctgcacagccttcacagtttgcggtgggagccgccaacagacccaagttctggacctgctactgaggagtcccagagggtcccccaaactgagagcatcatacatgttaccccattagactccaccatggagatggggcagctgagaatctcaggatccacaccctgcccacctccatctcgggcagctggaaaagtggtccttccaaatgggaaacctgtagcccaagctccattgcaggaagcaaggaagaaaacggatatcagccatgctgggcagaaagggaaggcagcctcaggaagaccagaaggaaccattgcttcccctctagggtctggggctccagatctccaggaagccatgcagaatctgcgtttggcaaccgctgaggcccaaagcctgcaccagcaggttctgagcaggcatccacagggctctgaccctgtagccacctccatgcctgtccaagatgttctgcaagcatccactcctgccactggggttactcaaggcagcatcaggcctgtggctggaagtgaagccaggatcccagcattccccagaaaggtcagtggggacaacaaagcagtccccagagggctgcctagggggtgggtgaccatacaggatggcatctacgctgctcaccctgtgagaacctctgacccacatggggctatccagccttctgaaaaagagccccatctgaggcacagcccaccccaggcagaccaaggtcagagtcccaggccggggtatcgtgagcctgggggtcatacacaaagggcttgggaacctctggggaaagtgatgccccaaatctcgcttgagtgcctccgggcagcagacacctccctgaagactgcccctctaactcaccacaccctgacatctaaaccagcaggtgccagcctgcactcccataatgcctctgttcctccccctcctactctcccagctgctgtgacagaagatcctgaccacccaactcaaggccaccaccaggaggactccatccagcaggccccggagcccctgcaggaaccccttcttcatattcacaacagaccttctggccagaaaacccctgaagggtcagagacaaaaccctccaaagcggaatccaccatgcttccaagaaagaaacccccagtgcctcccaaacctgcacatctaagccaaatccacccacctcagaggctgcccaagcccttagcaggctctgccagagcctcagaagcaggacaagaccataagccaggtgagccaggtatagccaacccagggtcagacaaagctcccacaatagcaggccaggactgcctgcctctggctgaaagctccaagggccagaagcaacctgctcatcagcgtccactcagctctatggcttccaggcctagcaggggtcagataaccagcagcaacagccagagccccgagtctcctaagttgaacgttctcaacaatgactccagcccaccacaaaagcacaatagctccccccaaaagcaggggacccctgagagtccacagggcagccatcaggagctccagggcctcctgagccaagtgcaaaccctggagaaggaagcatctcgcagcgtggatgtgcaggccctgcggaagctcttcgagggcgtaccccagctgggagggggagtccctcaggctcccactgccccccacatgactgaggcctccatggagcaggcctttggggaactgactcgggtgagtacagaggttgcccagctgaaagaacagaccctagccaggctgctggacatcgaagaagcagtgcacaaggctcttagctccatgtctagcctccagtctgaggctcccacaagcagccatccacagggaactacaaaagatcccagtgtgaacaaggtctcagtcagtagcagagccatacagacaagctccagccaggtcagagatccacccctcgtcaaaacccaagaaaaggccgagagccatcctgaggacaagatgagaaatcacgcagaggccagaggccaggcagcagtgaacgtcctgccctccaggaggctggagacactgagaggagccgagcctggcctcctacaagtctctcctccctgcacaggatcctcctctccaactttcatctcagtccaatcagctacaaagaagcttccggaagcttctagccctcagggaagccattatatctcagggaaaaatacacacctaggtcaggacataggtcaagccctgctctaccagagagatatccaggatcaggctgggacaaaggagatgtgcatcgagggcgctgtgctcacagggcagccaaagaatgttctggaattccagactgggtcaactacctccaagtcctatggagccatgagaacagtgaccgagcagtatgaggagatggaccaatttgggaatacagtcctcacttcctccaccaccatcacccagcacgcagacccactgacggaccccagaccccagctctgcctgcacacttctcccatgctaaggcagttactccacagcccctccaggctcaacagtgacctggcagaagctgagataacatggactccctgtaacaacttccacccggctgcccagtgagcccctctgtctcccaccagtcttgggtacctctcccagagctcccccaggactgagtcatgggcctacctccagcacatgtggaacaaggaccaagaaaaaaacgtgg

SEQ ID NO: 16 - DNA, 6451 bp, Homo sapiens
tggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctct

SEQ ID NO: 17 - DNA, 5472 bp, Canis lupus
atggccaaagcccagacgcaggcagcccccatgccgaccctcccgacggccgctgcagaggacctgcccctcccgccccccccagccctggacgatctgccgctgccaccgcccaaggagtccttctccaagttccaccagcagagacaagccagcgagctccgccgcctctacaggcacatccaccctgagctccgcaagaatctggccgaggccgtggctgaagacctggctgacgtcctggattccgaggagcccactgagggtgacgtccagtgtatgcgctggatctttgagaactggcggctcgatgccattggggaccgtgagaggccgcctgccagggagcccgtgcccggtggcaatgtccaggccacctcccgcaagtttgaggaaggctcctttgccaacagcacagagcaggagccagccggacctccgccatccggaggcgacgttcgtgcagcccgccagctgtttgagacaaagccgctggatgagctgactggccaggccgaggcgctggaggcggcggtgaaggagcccgaagccagcggcgatgtccagggtaccaggatgctctttgagacgcggccgctggaccgcctgggctcccgcccctccatccaggagcagagccccttggagctgcgctcggagatccaggagctgaagggcgatgtgaagaagacagtgaagctgttccaaacagagccactgtgtgccatccaggatgcagagggtgccatccacgaggtcaaggctgcatgccgggaagaaatccaaagcaatgcagtgaggtctgcccgctggctatttgagacccaacctctggatgctatcaacagggaccccagccaggtgcgggtgatccgggggatctccctggaggagggggcccggcccgatgtcagtgcaactcgctggatctttgagactcagccgttggacgccattcgggagatcttggtggatgagaaagacttccagccatccccagaccttatccctcctggtccagatgttcaacagcagcggcatttgtttgagacccgagccctagatactctcaagggggaagaggagtctgaagcacagcacccacccaaagaggaagtagtccctggtgatgtccgttctaccctgtggttatttgagacgaagcccctggacacacctagagacaaggtccaagtgggtcacctgcagcgagtgggtccccgggaccatgaggggctcatatctgagcatctatccagagatggctcctcagcagcatcccactctcagagtgccgcccagagggatggggtgaagggggacgtgaaggccttcaagaaccttttcgagacccttccccttgacagcatcgggcagggtgagccttcagcccataggagtatgaacagagcagaaggaactgattctactgggcagtcccaggacgtagggtccccagtatatgccatgcaggatggcaaaggccacctccatgccctgacctctgtcagcagagagcagatagttggaggcgatgtgcagggctacagatggatgtttgagacacagcctctggaccaactgggccgaagccccagtaccgtggatgtggtacggggcatcacccggcaggaagtggtggccggagacgtaggcactgcccggtggctctttgagacccagccactggaggtgatccaccagcgggaacggcagggacgccaggaagaagaaggaaagagtcaggcaggttcccagcctgaggcactccctaaaggtgacgtgcagaccatccggtggttgtttgagacatgccccatgagtgagttggcagagaagcaggggccagaggtcacagagcccacagctaaggccaagccccggtcctgcacctggatgtttgcgccccaacccctggagaggccagagggctccagggagcagcacctacaggttagccagatccaggctggggaaagacagacagacagacatgtcttcgaaactgagcctctgcaggcctcaggccgtccctgcggaagagggcctgtgcgatactgcagccgagtagagatcccttcaggtcaggtatctcggcagaaggaggttttccaggccctggaggcaggcaagagggaagagcaggggcccagggtcctccccgagcccatctctgtgggctccgtgcacaagttcacctggctctttgagaattgccctatgggctccctggcagccgaaagcatccgagggggcaacctcccagaagagcagcccacaggcccctcgggcagcagggtgcccgagaggcaggagacgggggctgaggggaccctgcggaccctgcacactctgcccggcctcttgcacgacgggggcatcctcatggaggtccgaggcccgggggagctctgcctggccaagtatgtgctcccaggcccgggggagggggggccccgcgtccggaaggaggagctggtgtctggcgagcttcccaggatcgtccgccaagtgctgcgccggccagatgtggaccagcaggggctgctggttcaggaggacccagcgggccagctccgccttaagccactgaggctgccagctccaggcggcagcgggaatattgaagacacagactctgagttccaacagctgctggcctgcggcctggggacctcagtagcaaggactgggctggtgatgcaggagacagagcagggcctggtctcgctgactgcctactccctgcaaccccagccgaacagcagggcccctgagaggggcagcgtgcagctgctggccagctgcatagacaagggagacctgagtggcctgcatagtctgagatgggagccaccagccgatccaagtccagtgccagccagtgagggggccccgaagctgcccccaactgagaacatcatccatgttccccccctggaccccagtatggggctggggcatctcagaggcccggggggcacctcccacctcccacagaccatggaaaagccagtgcctctagctggggagaaaaagcaagaagatagtcacactgggcagaaagggatggcagcttggggaaagtccgaagaaaccactactacccccctggggcctggggccccggacctccaggctgccatgcaagatctgcggatggccaccgccgaggcccaaagcctgcaccagcaagttctgaataaacacaagcaaggcattaaccctggagccacctcggcacccctggagccacctcggccagcaccggctgtggccactgtggctgctcagagccacactaggcctatggctggaggcaaccccaggatcccggcagcccccagaaaggtcagtggggaacagaaagcacctcccagagggctgcctggggggtgggtgactattcaggatggcatctacactgctcaccctgtgaggacctttgagccacctgggggtgtccagccttctgaaagagagcccctctcagtgcaggctcccagcccactccaggaaggcccaggccggactctggggcctgggcgggaggagcctgggggcggcacacagacggcctcaggacctccagagaaggcaatggcaagagatggcccaggagggctccaagctgcagagaccaccctgaaggttgcctctttagcccacccccctctggcctctgggcctctgcctgcgggtgccagtctgcactcccgtaatgcctctgttccccctcctcctcttctcccagctgctgtgacgggacctgacttcccagcccaagcccgccttgatgaggactctatccggcaggactccaagcttctcccctcccacggcagccctgccagccagcggacgcctggggaagcacagacaaggaccccaatactggagccaaaaatgcccccaaggaagaagcctccgctgcctcccaaacctgcccacctaagccagatctgccctcctcagaggctgcccacgccctcagctctatctcccagctcctgcaaagagtcagggcaaggagaacacaagccaggtgagagagacgcaaccacccttcggccagccaacattcccaccaccgcaggccagggatgcgtgtctctgtctggaggccccagtgaacagaaccagcccagcccccaaagcggccccagcaccatggcttccagacctactgagagccaggctgccagatgccatgaccagagccctaagtcccccaagttctcagctctcagcagccacccccccgcaccacaggagggtccccatcccccaagagagaggcccacagctggttcccagcaaggggcccctgagaacacggagattctgcagggaagccagcaagagctccagggcctgctgagccaggtgcaagccctagagagggaggccacaagcagtgtggatgtgcgggcactgaggaagctctttgaaactgtgccccagctgggagtggcccgcccggcttctgcggccccccacaaacccaaggcctctgtggtgcaggcctttggggagctgacaaaagtcagcacagaggtggccctgctgaagcaacagacactagccaggctgctggacattgaggaggctgtgcacaaggcgctcagctccatgtccagcctccagcctgagactaacaccagcggccattcccaaggaccgtccaaggaccacagtgcctgcaagagcagcgacacagatgggagtaaagccagacctcactgctccagccagggggtcagagggcaaactgcagtcaagaaccaaacccaagttgcaagccagactgaggtccagagtcaggccaaggtcagaaatcacacagaggccgggggtcaggcagcctcagtcatcccttcccccaggaggccagagacattgagagaagactcaagcctccctggagccttgccttccaacagagatccatcttgttccccaaccttcatctccattgagtcagcagtaaggaagcttccagaggctcccagccccaggggcatctttgaggtctcagtgaaaagcacacacctggcacaggctggactccaccagaaagggctccaggacaatgctggaaagaaggaagtcacccagtgcccttggcagcctgagcctgcccccgccttagccagccctctgcccacagggcagcagaagaacgttctggagctgcagactggactagatggttcccggtgctatgaagccacaggaacggttacccagcagtgtgatggggtggaccagtgcaggagcccggtcctcctgtcctctaccacggtcacggagcaggcagagatgaccaagggcccaggcccccacctcgagctccacgcttcacccctgctccggcagttcctgcgcagcccagccaggctcagcggtgcactggcagaagctgagacagtgcatgccccctgtggctactcccagccgggggcccagtga

SEQ ID NO: 18 - DNA, 6090 bp, Rattus norvegicus
atggccgatgcccagatgcaggtagttcatacaccaaccatccaaatgaggactggagaggacctgccccttccccctccctcagccctagagggtctgccgccaccgccccccaaagaatctttctccaagttccagcagcagcggcaagccaacgagcttcgccgtctctacaaacacatccaccctgagcttcggaagaacctcgaggaggctgtagccgaggacctggccaaggtactcggttcggaggagcccaccgagggcgatgtgcaatgtatgcgctggatctttgagaactggagtttggatgccattggcgaccacgagaggccagctggcaaggagcctgtgtcaggtggcaacgttcaggccacctctcggaagtttgaggaaggctcctttaccaacagctcagatctggagccaggaccccagctgtcagggggtgacgtccgagctaccagacagctgtttgagaccaagtcactggatgcactgacaggccaggaagaggcaacacagatgaccatgaaggaacctgcagtctctggagatgtacagggaaccagaaaactctttgagactaagcccctcgacatgctgggctcctgcccctctatccaggaccagagccctttagagctgcgctcagagattcaggagctgaagggtgatgtgaagaagacggtgaagctgtttcagacggagcctctatgtgccatccaggatgcagagggcgccatccatgaagtcaaggctgcctgtcgggaggagatccagagcaatgcagtgaggtcagctcgctggctctttgagacccgacctctggacgccttcaaccaggaccccagccaggtgagggtgattcgggggatctccctcgaggagggagccctgcccgacgtcagtgcaactcgctggatcttcgagacgcagcctctggatgccattcgtgagatcttggtggacgagaaggacttccagccatctccagatctcatccctcctggtccagacgttcagcatcagcgacatctgtttgagacctgcgccctggacactctgaagggagaaagagaaaccgaggcagaggctccagccaaggaggaggtgattcctggtgacgtccgctctacactctggctgtttgaaacaaaacccctggatgctttcagagaccaggtccaagtgggtcacctgcaacgggtggatcaccagaagggtgaggggcctgtgatagagtgtctgtccagtaacggcacttcagcgctgcctctgtctcagggtgtcccccagaacaatgggccgaaaggggatgtgaaaaccttcaagaatctttttgagacccttcccttagacagcattgggcagggtgagccttcagcctgtggaaacataaacagaggacaaaggactgattctactgggctgtccgagggcgccgatgcccccgtatatgctatgcaggacagcagaggacagcttcatgccctgacttctgtcagcagagagcaggtagttggaggtgatgtacaaggctacaagtggatgtttgagacacagcccctggaccggctgggcagaagccccagtaccgtggatgtggtgcgaggcatcacccggcaagaagtggtggctggggatgtaggcaccactcggtggctctttgagacgcaaccactggagatgatccaccaacaagagcagcagaagcgagaggaggaggaggggaggggtccaggaggcccccctcctgagctcccccagaagggcgatgtacaaaccatccgctggctatttgagacctaccctatgagcgagttggcagagaagcaggaatctgaggtcacaggccctgtgagcaaggcagaggcacagtcatgcacctggatgtttgggtcccaatctctgaaccaggcagagggctctggggagcagcacttgcaaaccagccaggtccaggctggagacagacagacagacagccatgtctttgagactgaatctctgtcagcccagggccagtccagtgggagaaagcctgtaaggtactgcagccgagtggagattccttccgggcaggtatctcggcagaaagaagttttccaagccctggaagcaggcaagaggggggtacaggagactgttttaagccccggatccatccccacaggctccgtgcataaattcacctggctctttgaaaactgccccatgggctccctggcagcagagagtgtcagtgggggcaacctccaggaagaacagcccaaagtctctgcagaccctgggaccccagagaggcaggagacagcagccgagagaacccttcggactttgcatgccacccctggcatcctgcaccacggagggatcctcatggaagcccgagggccaggggagctctgccttgccaagtatgtgctcccaagcccagggcaggggcgcccctgtgtacagaaggaggagctggtgtgcggtgagctccccaggatcgtccgtcaagtgctgggccggacagatgtggaccagcagggactgctggttcaggaggacacagctggccaactccgactccacccactcaaactgccagggcctggtgaccctgagaatattgaagacatggacccggagctccagcagctgctggcctgtggcctgggagtctctatggcaaagacggggctggtgatgcaagaaacaggacagggcctagtggcattgactgcctactccctccagccccagccaaccagcaggggccctgaaagaagcagtgtgcagctgctggccagctgcatagacaaaggagaactgcacagccttcccagtttgcggtgggagccgccaacagactcaagttcagtaccagttactgaggagacccagaggcttcccccaactgagagcatcatacgcgtcaccccattagactccaccatgaagatggggcatctgagagtctcaggatccacaccctgcccacctctacctcgggcagctggaaaagtggtccttccaaatgggagaccgggagcaccattgcaggaagcaaggaagcaagtggatatcagccatgctgggcagaaagggaaggcagcctcaggaagaccagaaggaaccattgctcctcctttagggtctggggctccaaatctccaggaggccatgcaaaatctgcgtttggcaactgctgaggcccaaagcctgcaccagcaggttctgagcaggcatgcacagggctctgaccctgcagccacctccatatctgctcaagatgttctgcaagtgccgactcctaccactacccaaggtagcatcatgcctgtggctggaagggacgccaggatcacagcggtccccagaaaggtcagtggagacaacaaagcagtccccagagggctgcctagggggcgggtgaccatacaggatggtatctatgctgctcaccctgtgagaacctctgacctacctggggccatccagccttctgaaaaagaaccccagccaagggacagcccaccccaggcagaccaaggtcagagtcccaggccagaatatcacgagcctgggggtcactcacaaagggcttggggacctctggggaaagtgatgccacaaatctggcctgagtgcctccaggcagcagacacctccctgaagactgtccctctaactcaccacactctgacacctaaaccccaggctgcaggtgacagcctgcactcccataatgcctctcctcctactctcccagctgctgtgacagaagaaccagaccacccagctcaaggccaccaccagaaggactccgtccagcaggcctccaagcccctgcgggaaccccttcttcacagtcacaacagacctgctggccagaaaacccttgaagggtcagagacaaagctctctaaagcggaatccactgtgcttccaagaaagaaacccccagtgcctccgaaacctgcccatctaagccaagtccacccacctcataggctgcccaagcccttagcagcctctgccagcatctcagaagcaggacaagaccataagccaggtgagccaggtgtagccaaccctgggtcggccaaagctcccacaatagcaggtcagggctgcctgcccctggctgagtgctccaaggggcagaaacagcctatgcgccagtatccactcagcaccacagcttccagacctagcgggggccaaacaagcaacagcaacagccagagccctgagtctcgcaagttgaccattctcaacaatgacaatgacgtcagcccaccacaaaagcaccctagctccccaaaacagcagcctatggatggttccaagcagaggacccctgagagcccagagattgttcagggcagccatcaagagctccagggcctcctgagccaagtgcaaaccctggagaaggaagcagcccacaccgtgaatgtgcagaccctgcggaagctctttgagggtgcaccccagctggcagggggtacccgtcaggttcccacagctcctcacaagactgaggtctcagtggagcaggcctttggggagctaactcgggtgagttcaaaggttgcccagctgaaagaacagaccctagccaggctgctggacatcgaagaaacagtgcacaaggctctgagctccatatttagcttccagtccgagggtcacacaagcagccctccacagggaagtgcaaaggatctcggtgtgaaaaaggtctccaccagtaacagagccagaccgatgggctccaaccaggtcaaagagccacctgcagtcgaaaaccaagaaaaggttgagagccgtcctgaggcgcaaggtcaagatgagattagaaatcatgcagaggccagaggtcaggcagcagtgaatgtcctgccctccaggaggctggagacggcaagagccgagcctggcctccaacaagtctcaccttcctgcaggggatcctcctctccaactttcatctctatccaatcagctgcaaagacgcttctagatgcttccagccctcagggaagccattctatctcagggaaaaatacacacctagctcaggacataagccaagccctgctctaccagagagatatccaggatcaggctgggacaaaggagatggccatcaagggctctgtgcccacagggcagcaagagaatgttctggaattccagactgggtctgctacctccaagtcctatggagccacgaaaacagtgactgaacagtatgaggagatggaccaatttgggaatacagtcctcacttcctccaccaccatcacccagcaggcagagcctctgatggaccccaggccccaactcgggctctacacttttcccatgctaaggcagttcctccacagtccctccaggttcaacagcgacctggctggtgccgagataccatgggttccctgtagccacttccatccggctgcccagtgagcccctctgtctccccccagtcttgggttcctcccccagagctctaggactgagtcacgggcctacctccaggacatgtggaacaatgaccaagaaaaacggggccttcggagagctgatgagggctgtttgccttgttcgttccaattcttgggaagggacaagaaaagtaaagcagccatccacaggaaagctggatgggtaggacaggacctgacaggtggttgtggagatctagcccacactagcccagctcacattcgcacattcgagtctgcatcttattgcctagagctggatagacacccctccactgtgtccctctatggccagcctttctcttaggttatggaatgtggctacctcaatccctggtgaggacccggggctgagcagactggacatgacattggtctctatttgagattggactgaaggttccagaaaaacctgggtgctgcctcttcatcaccagtggtccaaagggcactgagagaacgctagcagccaatagtgttcctagcagccgaatacaccacccttcctgatcccatcacccccccactctgcacccccaatgggaaaaatgacccaaaaataaacccaaaagagattctctgc

SEQ ID NO: 19 - DNA, 2309 bp, Mus musculus
gttaggccaacagggaagcgcggagccgcagatcttgccggtctctcgctggggtgtctggaactgagctgcggcagggtctggctccagctcgactgcccgagggggtgtgcgtgcgagccgcggagggtgtgctcggaggcccgcgccgtggctgtggccgtggccgtggcggctgcagccgcctcggggaatctaatatcagctacctgtccctgtcactcttgacacttcgctgtcagggctgcagcgcggggggcgggcaaagcgctctcgtagctgtccttattggaggggtatcaaggggagggagggaggcaagaaaagggtctttgcccattcttgtttcgctttggatcgtggaagtcggctccctaaagaggctcgcagcggttccctcctgcccacgtccccacgtctgcgttggcccccctgcctttcggctgccgaactctttttggctggagtctgaagctagaggagacagggctggaggattcggcagtttgcgttccctggctctttcaagtctcggctaacacggggacacttggcgcctagagcgctaccgagaaccggcggccaccggggctccactggcggtagccctggactcatagggctccgcactccctcgtccatgaactgcatgaaaggcccgctgcccttggagcaccgagcagccgggactaagctgtcggccgcctcctcacccttctgtcaccatccccaggcgttagccatggcttcggtcctagctcctggccagccccgctccttggactcctccaaacatagactggaggtgcatacaatctccgatacttccagccctgaagtcgcagagaaagataagggccagcaaggaaagaatgaggatgtgggcgccgaggacccgtccaagaagaagcggcaacgccggcagaggactcatttcactagccagcagctgcaggagctggaagccactttccagagaaaccgctacccagacatgtccactcgcgaagaaatcgccgtgtggaccaaccttacggaagcccgagtccgggtttggttcaagaatcgccgggccaaatggagaaagcgggaacgcaaccagcaggccgagctgtgcaagaatggctttgggccgcagttcaacgggctcatgcagccctacgatgacatgtaccccggctattcgtacaacaattgggctgccaagggcctcacgtcagcgtctctgtccaccaagagcttccccttcttcaactccatgaacgtcaatcccctgtcctctcagagtatgttttccccgcccaactccatctcatctatgagtatgtcgtccagcatggtgccctccgcggtgaccggcgtcccgggctccagcctcaatagcctgaataacttgaacaacctgagcagcccgtcgctgaattccgcggtgcccacgcccgcctgtccttacgcgccgccgactcctccgtacgtttatagggacacatgtaactcgagcctggccagcctgagactgaaagcaaagcagcactccagcttcggctacgccagcgtgcagaacccggcctccaacctgagtgcttgccagtatgcagtcgaccggccggtgtgaaccgcgcccagggcgcggggatccgaggactgtcggagtgggcaactctgccccagaaagactgagaattgtgctagaaggtcgtgcgcactatgggaaggaagaggggggaaaaaagatcagaggaaaagaaaccactgaattcaaagagagagcgcctttgatttcaaaggaatgtccccaagtgtctacgtctttcgctaagagtattcccaacagttggaggacgcgtacgcccacaaatgtttgactggatatgacattttaacattactataagcttgttattttttaagtttagcattgttaacattaaaatgactgaaaggatgtatatatatcgaaatgtcaaattaattttataaaagcagttgttagtactatcacgacagtgtttttaaaggctaggctttaaaataaagcatgttatacagaatcagttaggatttttcgcttgcgagcaaaggaatgtatatactaaatgccacactgtatgtttctaacatattattattataaaaatgtgtgaatataagttttagagtagtttctctggtggatgccttgtttctgaaactgctatgtacgacccatcctgtgtataacatttcgtacgatattattgttttacttttcagcaaatatgaaaaaaaatgtgttttatttcttgggagtaaaatatactgcatacaaa

SEQ ID NO: 20 - DNA, 1759 bp, Mus musculus
ggagagagagtgcgagaccgagagagaaagccggagagcagcagacagaaactgccggcgcccgctagctttagcagccccccgcgtggaccctctcggaacttggcaccctcaagatccccgcagttccacccagacccgctccacggcgctggctgtgcagcccgagcctcggccgcctggcagtcaccctgggaagcggtgggacggggagacagccgttctctctccggtagccgataaccgggaatggagaccaattgtcgcaaactagtgtcggcctgcgtgcaattagagaaagataagggccagcaaggaaagaatgaggatgtgggcgccgaggacccgtccaagaagaagcggcaacgccggcagaggactcatttcactagccagcagctgcaggagctggaagccactttccagagaaaccgctacccagacatgtccactcgcgaagaaatcgccgtgtggaccaaccttacggaagcccgagtccgggtttggttcaagaatcgccgggccaaatggagaaagcgggaacgcaaccagcaggccgagctgtgcaagaatggctttgggccgcagttcaacgggctcatgcagccctacgatgacatgtaccccggctattcgtacaacaattgggctgccaagggcctcacgtcagcgtctctgtccaccaagagcttccccttcttcaactccatgaacgtcaatcccctgtcctctcagagtatgttttccccgcccaactccatctcatctatgagtatgtcgtccagcatggtgccctccgcggtgaccggcgtcccgggctccagcctcaatagcctgaataacttgaacaacctgagcagcccgtcgctgaattccgcggtgcccacgcccgcctgtccttacgcgccgccgactcctccgtacgtttatagggacacatgtaactcgagcctggccagcctgagactgaaagcaaagcagcactccagcttcggctacgccagcgtgcagaacccggcctccaacctgagtgcttgccagtatgcagtcgaccggccggtgtgaaccgcgcccagggcgcggggatccgaggactgtcggagtgggcaactctgccccagaaagactgagaattgtgctagaaggtcgtgcgcactatgggaaggaagaggggggaaaaaagatcagaggaaaagaaaccactgaattcaaagagagagcgcctttgatttcaaaggaatgtccccaagtgtctacgtctttcgctaagagtattcccaacagttggaggacgcgtacgcccacaaatgtttgactggatatgacattttaacattactataagcttgttattttttaagtttagcattgttaacattaaaatgactgaaaggatgtatatatatcgaaatgtcaaattaattttataaaagcagttgttagtactatcacgacagtgtttttaaaggctaggctttaaaataaagcatgttatacagaatcagttaggatttttcgcttgcgagcaaaggaatgtatatactaaatgccacactgtatgtttctaacatattattattataaaaatgtgtgaatataagttttagagtagtttctctggtggatgccttgtttctgaaactgctatgtacgacccatcctgtgtataacatttcgtacgatattattgttttacttttcagcaaatatgaaaaaaaatgtgttttatttcttgggagtaaaatatactgcatacaaa

SEQ ID NO: 21 - DNA, 1903 bp, Mus musculus
gggaggggagagagagtgcgagaccgagagagaaagccggagagcagcagacagaaactgccggcgcccgctagctttagcagccccccgcgtggaccctctcggaacttggcaccctcaagatccccgcagttccacccagacccgctccacggcgctggctgtgcagcccgagcctcggccgcctggcagtcaccctgggaagcggtgggacggggagacagccgttctctctccggtagccgataaccgggaatggagaccaattgtcgcaaactagtgtcggcctgcgtgcaattaggcgtgcagccggcagccgttgaatgtctcttctccaaagactccgaaatcaaaaaggtcgagttcacggactctcccaagagccggaaagagtcggccagcagcaagctgttcccgcggcagcaccccggcgccaatgagaaagataagggccagcaaggaaagaatgaggatgtgggcgccgaggacccgtccaagaagaagcggcaacgccggcagaggactcatttcactagccagcagctgcaggagctggaagccactttccagagaaaccgctacccagacatgtccactcgcgaagaaatcgccgtgtggaccaaccttacggaagcccgagtccgggtttggttcaagaatcgccgggccaaatggagaaagcgggaacgcaaccagcaggccgagctgtgcaagaatggctttgggccgcagttcaacgggctcatgcagccctacgatgacatgtaccccggctattcgtacaacaattgggctgccaagggcctcacgtcagcgtctctgtccaccaagagcttccccttcttcaactccatgaacgtcaatcccctgtcctctcagagtatgttttccccgcccaactccatctcatctatgagtatgtcgtccagcatggtgccctccgcggtgaccggcgtcccgggctccagcctcaatagcctgaataacttgaacaacctgagcagcccgtcgctgaattccgcggtgcccacgcccgcctgtccttacgcgccgccgactcctccgtacgtttatagggacacatgtaactcgagcctggccagcctgagactgaaagcaaagcagcactccagcttcggctacgccagcgtgcagaacccggcctccaacctgagtgcttgccagtatgcagtcgaccggccggtgtgaaccgcgcccagggcgcggggatccgaggactgtcggagtgggcaactctgccccagaaagactgagaattgtgctagaaggtcgtgcgcactatgggaaggaagaggggggaaaaaagatcagaggaaaagaaaccactgaattcaaagagagagcgcctttgatttcaaaggaatgtccccaagtgtctacgtctttcgctaagagtattcccaacagttggaggacgcgtacgcccacaaatgtttgactggatatgacattttaacattactataagcttgttattttttaagtttagcattgttaacattaaaatgactgaaaggatgtatatatatcgaaatgtcaaattaattttataaaagcagttgttagtactatcacgacagtgtttttaaaggctaggctttaaaataaagcatgttatacagaatcagttaggatttttcgcttgcgagcaaaggaatgtatatactaaatgccacactgtatgtttctaacatattattattataaaaatgtgtgaatataagttttagagtagtttctctggtggatgccttgtttctgaaactgctatgtacgacccatcctgtgtataacatttcgtacgatattattgttttacttttcagcaaatatgaaaaaaaatgtgttttatttcttgggagtaaaatatactgcatacaaa

SEQ ID NO: 22 - DNA, 2337 bp, Homo sapiens
gttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaaaaaaaaaaaaaaaaaaaaa

SEQ ID NO: 23 - DNA, 2250 bp, Homo sapiens
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaaaaaaaaaaa

SEQ ID NO: 24 - DNA, 2122 bp, Homo sapiens
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaaaaaaaaaaaaaaaaaaaaa

SEQ ID NO: 25 - DNA, 1874 bp, Pan troglodytes
gcagtctgtgtaagttttcatatctctgagtgtgtgcacacagtggagagggtggagccttccatcctcaaatctgaaaagattgagagatttcagagggcccagatgtgccaaaggtcagagggatcaatatacaggccctaccacggaaaggcggggaaaaggttcgaataaaaaactgctgcagaagggaagccactgagagataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 26 - DNA, 1629 bp, Pan troglodytes
gtgccaaaggtcagagggatcaatatacaggccctaccacggaaaggcggggaaaaggttcgaataaaaaactgctgcagaagggaagccactgagagataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 27 - DNA, 3319 bp, Pan troglodytes
aggttcgaataaaaaactgctgcagaagggaagccactgagaggagcaaatgtggacttgagggaaactctctcccccacccccacttctatcccgtgcaatttaataccatcctcgccaggaaccttaacctcgtcattttaaaaaatgagatatccgtgacccagggtgaacttgttgaatgtaggtacagcagaggaaattctagactctatgagcgtctgagcctcgtccagtgcaaacccttcgtgaacactggtcagtgcgtggccgtgcccacctgtgcgccgacactctcagcatgcctggtccacccgccttgacctcgggcgcggtgtcccagctaagcggggcccagcgtcccggccttccccagctgacaagcctagctcgttcgctcccggctgtggccctcccaccctctcccactagctcactccattcttccagatttctcttcactcatcctctcccatccccaccgcgcccacctccactcccgccctctaccggtctctcactttcctccctccgcagtccctctttgctgtgacctctttcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcctctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggaggggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggagcctcggctcgctggaaatcgccccgggaagcagtgggacgcggagacagcagctctctcccggtagccgaatcactaaatctggagccgccaaactgctacttctgggcccacgggcccacaaggatcgaatcggcagagtccccgcccgcgttctcgctagcgggtgggggaaccgcctggccgtccccaccctggatccccacgccacagcgccgggcagcccctcctgtaggcagcgaccttggccagaggctccccagggcccagctcccttcaggagaggccgagacgcagggaaacgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 28 - DNA, 2103 bp, Pan troglodytes
tgggagtccgtgctcctgctcctcggttggctcctaagtgccccgccaggtcccctctcctttcgctctcccggctccggctcccgactcttcggcccgctggcctctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggaggggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggagcctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 29 - DNA, 2241 bp, Pan troglodytes
tgggagtccgtgctcctgctcctcggttggctcctaagtgccccgccaggtcccctctcctttcgctctcccggctccggctcccgactcttcggcccgctggcctctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggaggggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggagcctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 30 - DNA, 1999 bp, Pan troglodytes
aagggggtctttgcccactcttgtttcgctttggagcttggaagcctgctccctaaagacgctccgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccgaggactagtagagcgtcgcgctccctcgtccatgaactgcatgaaaggcccgcttcacttggagcaccgagcagcggggaccaagctgtcggccgtctcctcatcttcctgtcaccatccccagccattagccatggcttcggttctggctcccggtcagccccgctccctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacgggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttccaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaaaaaatgtgttttatttcatgggagtaaaatatactgcatacaaattg

SEQ ID NO: 31 - DNA, 1665 bp, Canis lupus
cggggaatggagaccaactgccgcaaactagtgtcggcgtgtgtgcaattaggcgtgcagccggcggccgttgaatgcctcttctccaaagactccgaaatcaaaaaggtcgagttcacagactctcccgagagccggaaagaggcggccagcagcaagctcttcccgcggcagcatcccggcgccactgagaaagataagagccagcagggaaagaatgaggacgtgggcaccgaagacccgtccaagaagaagcggcaacggcggcagcgcactcacttcaccagccagcagttgcaggaactggaggccactttccagaggaaccgctacccggacatgtccacgcgcgaggaaatcgccgtgtggaccaaccttacggaagcccgagttcgggtttggttcaagaatcgcagggccaaatggagaaagcgggagcgcaaccagcaggccgagctgtgcaagaatggctttgggccgcagttcaatggccttatgcagccgtacgatgacatgtaccccggctattcctacaacaactgggccgccaagggtctcacgtcagcctccctgtccaccaagagcttccctttcttcaactctatgaatgtcaaccccctatcgtcgcagagcatgttctccccacccaactccatctcctccatgagcatgtcgtccagcatggtgccctcagctgtgaccggcgtcccgggctccagcctcaacagcctgaataacttgaacaacctgagcagcccgtcgctgaattccgcggtgcccacgcctgcctgtccttacgcgccgccgactcctccgtacgtttacagggacacgtgtaactcgagcctggccagcctgagactgaaagcaaagcagcattccagctttggctacgccagcgtgcagaacccggcgtccaacctgagtgcttgccagtacgccgtggaccggccggtgtgagcctcgcccacagcacccggatcctaggaccgtgccggatggggcaactctgcccttgaaagactgggaattacgctagaaggtcgtgggcactaaggaaaggaagagaaagaagatataaagagaaaaggaaaccactgaataaagagagctcctttgatttcaaaggaatttcctcaatgtctgacatctttcactaaaagtatttccaacagttgcaaggacacacacaaatgtttgactggatatgacattttaacattactataagcttgttattttttaagtttagcattgttaacattaaaatgactgaaaggatgtatatatatcgaaatgtcaaattaattttataaaaagcagttgttagtactatcacaacagtgtttttaaaggttaggctttaaaataaagcatgttatacagaagcgattagggtttttcgcttgtgagcaaaggaatgtatatactaaatgccacactgtatgtttctaacatattattattataaaaatgtgtgaatatcagttttagaatagtttctctggtggatgcaatgatgtttctgaaactgctatgtacaacctaccctgtgtataacatttcgtacaatattattgttttacttttcagcaaatatgaaaaatgtgttttatttcatgggagtaaaatatactacatacaaatcaaaaaaaaaaaaaaaaa

SEQ ID NO: 32 - DNA, 1866 bp, Canis lupus
atgaactgcatgaaaggcccgctgcatttggagcaccgagcagtagggaccaagctgttggccaccgcctcgccttcctcctgtcaccatccccagccactggccatggcttcagtcctggctcccggtcagacccgctccctggactcggctaagcacaggctggaggtgcacaccatctctgacacctccagccccgaggccgcagagaaagataagagccagcagggaaagaatgaggacgtgggcaccgaagacccgtccaagaagaagcggcaacggcggcagcgcactcacttcaccagccagcagttgcaggaactggaggccactttccagaggaaccgctacccggacatgtccacgcgcgaggaaatcgccgtgtggaccaaccttacggaagcccgagttcgggtaggacccctggcggagcctgggaaggctgggaaggagggcaagggttgcgtcggggccaccggacgcgggtgggggctgaccgggttaggcggctgcttgaaaagcccagcaaactgtctgggcccggctggtgcgcgccgggtgaggggcctggcctggagtgggcggagggaggaggaggtttggttcaagaatcgcagggccaaatggagaaagcgggagcgcaaccagcaggccgagctgtgcaagaatggctttgggccgcagttcaatggccttatgcagccgtacgatgacatgtaccccggctattcctacaacaactgggccgccaagggtctcacgtcagcctccctgtccaccaagagcttccctttcttcaactctatgaatgtcaaccccctatcgtcgcagagcatgttctccccacccaactccatctcctccatgagcatgtcgtccagcatggtgccctcagctgtgaccggcgtcccgggctccagcctcaacagcctgaataacttgaacaacctgagcagcccgtcgctgaattccgcggtgcccacgcctgcctgtccttacgcgccgccgactcctccgtacgtttacagggacacgtgtaactcgagcctggccagcctgagactgaaagcaaagcagcattccagctttggctacgccagcgtgcagaacccggcgtccaacctgagtgcttgccagtacgccgtggaccggccggtgtgagcctcgcccacagcacccggatcctaggaccgtgccggatggggcaactctgcccttgaaagactgggaattacgctagaaggtcgtgggcactaaggaaaggaagagaaagaagatataaagagaaaaggaaaccactgaataaagagagctcctttgatttcaaaggaatttcctcaatgtctgacatctttcactaaaagtatttccaacagttgcaaggacacacacaaatgtttgactggatatgacattttaacattactataagcttgttattttttaagtttagcattgttaacattaaaatgactgaaaggatgtatatatatcgaaatgtcaaattaattttataaaaagcagttgttagtactatcacaacagtgtttttaaaggttaggctttaaaataaagcatgttatacagaagcgattagggtttttcgcttgtgagcaaaggaatgtatatactaaatgccacactgtatgtttctaacatattattattataaaaatgtgtgaatatcagttttagaatagtttctctggtggatgcaatgatgtttctgaaactgctatgtacaacctaccctgtgtataacatttcgtacaatattattgttttacttttcagcaaatatgaaaaatgtgttttatttcatgggagtaaaatatactacatacaaatcaaaaaaaaaaaaaaaaa

SEQ ID NO: 33 - DNA, 1683 bp, Canis lupus
atgaactgcatgaaaggcccgctgcatttggagcaccgagcagtagggaccaagctgttggccaccgcctcgccttcctcctgtcaccatccccagccactggccatggcttcagtcctggctcccggtcagacccgctccctggactcggctaagcacaggctggaggtgcacaccatctctgacacctccagccccgaggccgcagagaaagataagagccagcagggaaagaatgaggacgtgggcaccgaagacccgtccaagaagaagcggcaacggcggcagcgcactcacttcaccagccagcagttgcaggaactggaggccactttccagaggaaccgctacccggacatgtccacgcgcgaggaaatcgccgtgtggaccaaccttacggaagcccgagttcgggtttggttcaagaatcgcagggccaaatggagaaagcgggagcgcaaccagcaggccgagctgtgcaagaatggctttgggccgcagttcaatggccttatgcagccgtacgatgacatgtaccccggctattcctacaacaactgggccgccaagggtctcacgtcagcctccctgtccaccaagagcttccctttcttcaactctatgaatgtcaaccccctatcgtcgcagagcatgttctccccacccaactccatctcctccatgagcatgtcgtccagcatggtgccctcagctgtgaccggcgtcccgggctccagcctcaacagcctgaataacttgaacaacctgagcagcccgtcgctgaattccgcggtgcccacgcctgcctgtccttacgcgccgccgactcctccgtacgtttacagggacacgtgtaactcgagcctggccagcctgagactgaaagcaaagcagcattccagctttggctacgccagcgtgcagaacccggcgtccaacctgagtgcttgccagtacgccgtggaccggccggtgtgagcctcgcccacagcacccggatcctaggaccgtgccggatggggcaactctgcccttgaaagactgggaattacgctagaaggtcgtgggcactaaggaaaggaagagaaagaagatataaagagaaaaggaaaccactgaataaagagagctcctttgatttcaaaggaatttcctcaatgtctgacatctttcactaaaagtatttccaacagttgcaaggacacacacaaatgtttgactggatatgacattttaacattactataagcttgttattttttaagtttagcattgttaacattaaaatgactgaaaggatgtatatatatcgaaatgtcaaattaattttataaaaagcagttgttagtactatcacaacagtgtttttaaaggttaggctttaaaataaagcatgttatacagaagcgattagggtttttcgcttgtgagcaaaggaatgtatatactaaatgccacactgtatgtttctaacatattattattataaaaatgtgtgaatatcagttttagaatagtttctctggtggatgcaatgatgtttctgaaactgctatgtacaacctaccctgtgtataacatttcgtacaatattattgttttacttttcagcaaatatgaaaaatgtgttttatttcatgggagtaaaatatactacatacaaatcaaaaaaaaaaaaaaaaa

SEQ ID NO: 34 - DNA, 2019 bp, Rattus norvegicus
tctaggggagggagggaggcaagaaaagggtctttgcccattcttgtttcgctttggatcgtggaagtcggctccctaaagacgcttgcagcggttcccttctgcccacgtccccaagtctccgttggccccctgactttcggctgccgaactctgtttggctggagtctgcagttagaagagacaggggcagtttggctggaggaccctgcagtttgcgtcccctggctctacaagtctcggctaacacagggacacttggcgcctagagcgctacccagaaccggcggccaccggggctcgacaggcgggagccctggactcgtagggcaccgcactccctcgtccatgaactgcatgaaaggcccgctgcccttggagcaccgagcagccgggactaagctgtcggccgcttcctcacccttctgtcaccatacccaggcgttagccatggcttcggtcctagctcctggtcagccccgctccctggacgcctccaaacatagactggaggtgcatacaatctccgatacgtccagccctgaagtcgcagagaaagataagggccagcagggaaagaatgaggatgtgggcgcagaggacccgtccaagaagaagcggcaacgccggcagaggactcactttactagtcagcagctccaggagctggaagccactttccagagaaaccgctacccagacatgtccactcgcgaagaaatcgccgtgtggaccaaccttacggaagcccgagtccgggtttggttcaagaatcgccgggccaaatggagaaagcgggagcgcaaccagcaggccgagctgtgtaagaatggcttcgggccgcagttcaatgggctcatgcagccgtacgatgacatgtaccccggctactcgtacaacaattgggctgccaagggcctcacgtcagcgtctctgtccaccaagagcttccccttcttcaactctatgaacgtcaatcccctatcctcccagagcatgttttccccgcccaactccatctcatccatgagtatgtcgtccagcatggtgccgtccgcggtgaccggcgtcccgggctccagcctcaatagcctgaataacttgaacaacctgagcagcccgtcgctgaattccgcggtgcccacgcccgcctgtccttacgcgccgccgactcctccgtacgtttatagggacacatgtaactcgagcctggccagtctgagactaaaagcaaagcaacactccagcttcggctacgccagcgtgcagaacccggcctccaacctgagcgcttgccagtatgcggtcgaccggccggtgtgaaccgcgcccagggcgcgggattccgaggactgtcggagtgggcaactctgcccgagaaagactgagaattgtgctagaaggtcgtgcgcactacggggagaaagagggggggacaaaagagatcagaggaaaagaaaccactgaattcaaagagagagagcgcctttgatttcaaaggaatgcccccaagtgtctgccatcttccgctgaaagtattcccaacagttggaggacgcgtgcaccaacaaatgtttgactggatatgacattttaacattactataagcttgttattttttaagtttagcattgttaacattaaaatgactgaaaggatgtatatatatcgaaatgtcaaattaattttataaaagcagttgttagtactctcacgacagtgtttttaaaggctaggctttaaaataaagcatgttatccagaatcagttaggatttttcgcttgcgagcaaaggaatgtatatactaaatgccacactgtatgtttctaacatattattattataaaaaatgtgtgaatataagttttagagtagtttctctggtggatgccttgtttctgaaactgctacgtacaacctatcctgtgtataacatttcgtacgatattgttttacttttcagcaaatatgaaaaaatgtgttttatttcttgggagtaaaatataccgcatacaaa

SEQ ID NO: 35 - DNA, 1716 bp, Rattus norvegicus
agcagacagaaactgcccgcacccgctagctttagcagccctcagcgtggaccctctcgcaacttggcaccctcaagatccctgcggttccaaccagacccgctccacggcgctggctgtgcagcccgagcctcggccgcctggcagtcaccctgggaagcggtgggacggggagacagccgttctctctggtagccgataacggggaatggagaccaattgtcgcaaactagtgtcggcctgtgtgcaattagagaaagataagggccagcagggaaagaatgaggatgtgggcgcagaggacccgtccaagaagaagcggcaacgccggcagaggactcactttactagtcagcagctccaggagctggaagccactttccagagaaaccgctacccagacatgtccactcgcgaagaaatcgccgtgtggaccaaccttacggaagcccgagtccgggtttggttcaagaatcgccgggccaaatggagaaagcgggagcgcaaccagcaggccgagctgtgtaagaatggcttcgggccgcagttcaatgggctcatgcagccgtacgatgacatgtaccccggctactcgtacaacaattgggctgccaagggcctcacgtcagcgtctctgtccaccaagagcttccccttcttcaactctatgaacgtcaatcccctatcctcccagagcatgttttccccgcccaactccatctcatccatgagtatgtcgtccagcatggtgccgtccgcggtgaccggcgtcccgggctccagcctcaatagcctgaataacttgaacaacctgagcagcccgtcgctgaattccgcggtgcccacgcccgcctgtccttacgcgccgccgactcctccgtacgtttatagggacacatgtaactcgagcctggccagtctgagactaaaagcaaagcaacactccagcttcggctacgccagcgtgcagaacccggcctccaacctgagcgcttgccagtatgcggtcgaccggccggtgtgaaccgcgcccagggcgcgggattccgaggactgtcggagtgggcaactctgcccgagaaagactgagaattgtgctagaaggtcgtgcgcactacggggagaaagagggggggacaaaagagatcagaggaaaagaaaccactgaattcaaagagagagagcgcctttgatttcaaaggaatgcccccaagtgtctgccatcttccgctgaaagtattcccaacagttggaggacgcgtgcaccaacaaatgtttgactggatatgacattttaacattactataagcttgttattttttaagtttagcattgttaacattaaaatgactgaaaggatgtatatatatcgaaatgtcaaattaattttataaaagcagttgttagtactctcacgacagtgtttttaaaggctaggctttaaaataaagcatgttatccagaatcagttaggatttttcgcttgcgagcaaaggaatgtatatactaaatgccacactgtatgtttctaacatattattattataaaaaatgtgtgaatataagttttagagtagtttctctggtggatgccttgtttctgaaactgctacgtacaacctatcctgtgtataacatttcgtacgatattgttttacttttcagcaaatatgaaaaaatgtgttttatttcttgggagtaaaatataccgcata

SEQ ID NO: 36 - DNA, 2056 bp, Mus musculus
  modified_base (1758)..(1758): a, c, t, g, unknown or other
gcttggctcagtgtgagcgagccacctcgaaggcctgacagactctgagatgacaataggcagcatggagaacgtggaggtcttcacttccgagggcaaaggcagaggtctgaaggctacgaaggagttctgggctgcggatgtcatctttgcggagagggcttattctgcagtggtttttgacagcctcattaacttcgtgtgccacacctgcttcaagaggcaggagaagctccatcgctgcgggcagtgcaagttcgcccattactgcgaccgcacgtgccagaaggatgcttggctgaatcacaagaacgagtgcgctgccatcaagaaatatgggaaagtgcccaacgagaacatcaggctggccgcccgcatcatgtggcgggtggagagagagggcactgggctcacagagggctgcctggtgtccgtggatgacttacagaaccacgtggagcactttggggaggaggagcagaaggaactccgagtagacgtggacacgttcttgcagtactggccaccacagagccagcagttcagcatgcagtatatctcacacatctttggtgtgatcaactgcaacggtttcactctcagtgaccagagagggctacaggcagtaggtgtgggcatcttccccaacctgggcctggtgaaccatgattgctggccaaactgcactgtcatattcaacaatggcaagattgagctccgggccctgggcaagatctcagaaggcgaggagctgactgtgtcctacatagacttcctgcacctcagtgaggagcgcaggcggcagctgaagaaacagtactactttgactgctcctgtgagcactgccagaaggggctgaaggacgacctcttcctggcagcgaaggaagaccccaagccctcccaggaagtggtgaaggagatgatacaattctcaaaggatacactggaaaaaatagacaaggctcgctccgagggtttgtatcacgaggttgtgaagctgtgtcgggagtgcctggagaagcaggagccagtgttcgccgacaccaacctctacgtgcttcggctgctcagcattgcatcagaggtcctctcctacctccaggcctatgaggaagcctcacattatgccaggaggatggttgatggctacatgaaactctaccaccataacaatgcccaactgggcatggctgtgatgagggcagggcttaccaactggcatgctggtcacatcgaagtggggcatgggatgatctgcaaagcctatgctattctcctggtgacccatggaccctcccaccctatcaccaaagacttagaggccatgcggatgcagacagagatggagctgcgtatgttccgccaaaacgaattcatgtatcacaagatgcgagaggctgccctgaacaaccagcccatgcaggtcatggctgagcctagcaatgaaccagcccccgctctgttccataagaagcagtgaggaccttgttggagggtgggggggctgtggctggggagctgaggaaatgactactctgtgtcctccactgtcgttttggttcaattcaattcagtttagttctctttcatttcagaccaactcttcctacatgtgtcaggtgctagatcccaccatctatttaataagggagccccaaatataattgtgctagaaagaaaaatgtaaacaaacaaggcacagcataatagtaaatgccatggtgagctctatgcagaggggtttgtttaggggangtgagtttgtgtgtgtatcgggtgggggtaacacctgagctaagagtggcaggtacctagaatcccaggtgactgcttgtgtatctgtgtaggcatctctggggctgctggtctcatctacagttatgaatatttaggttttgcagactggggtgggtgatgtcctgaatcctcaggccaaaagtgtttgaccctttgagatatactcagtgatgcctagaaagatgcagggatcttgggatcctgtggtctttactcctaatcagagcttgaagcataactttaaaataactctaga

SEQ ID NO: 37 - DNA, 4364 bp, Homo sapiens
agatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcaggggagggaatgtgtctggtgtgtgatgtgtgtatgtgcagtgggggtatcacagagagtatgacatctgagttaagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggcgcatatgtcgaaagagctggctgggggccttgcccaaaccaactgaggtcttaaagtccagggaaaaaaagtctgggttccaactagaattctagaaatatttctagaacacacagagagggaataagtccctctatcacccttattaccaagccttgtggttccctgtgattttagacaatgtctgatatttttctggctatttgcctagtaggatttaaaaaatattttcaaagtgaagctgagagagaatcttggaaacacacatacctgttgatcatgggccctgcagaattggcccttgggggctttatttggttacatgtgcctgggtggtctttaccagcttagactctaccatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttagggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgtttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaaggactcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaaaaaaaaaaaaaaaaaaa

SEQ ID NO: 38 - DNA, 1392 bp, Canis lupus
tgcctgagggactctgagatgacaatagggagaatggagaacgtggaggtcttcacttctgagggcaagggcagaggtctgaaggccactaaggagttctgggctgcggatgtcatctttgctgagcgggcttattccgcagtagtttttgacagccttgttaactttgtgtgccatacctgcttcaagaggcaggagaagctccatcactgtggacagtgcaagtttgcccactattgtgaccgcacctgccagaaggatgcttggctgaaccacaagaatgagtgttcggccatcaagagatatgggaaggttcccaatgagaatatcaggctggcggcccgcatcatgtggcgggtggagagagagggcaccgggctcacagagggctgcctggtcgctgtggatgacctgcagaaccacgtggagcactttggggaggaggaacaaaaggagctacggctggacgtggacactttcttgcagtactggccaccccagggccagcagttcagcatgcagtacatctcgcacatctttggcgtgattagctgcaatggcttcacactcagtgaccagagaggcctacaggcagtgggtgtgggcatcttccccaacctgggcttggtgaaccacgactgttggcccaactgcactgtcatattcaacaatggcaaaattgagcttcgggccctgggcaagatctcagaaggagaggagctgacagtgtcctatatcgacttccttaacctcagcgaagaccgcaagaagcagctaaagaagcagtactactttgactgcacgtgtgaacactgccagaaaaagctgaaggatgacctattcctgggggtgaaagatgacccaaagccctctcaggaggtggtaaaggagatgatacaattctccaaggatacactggaaaaaatagacaaggctcgttctgagggtctgtaccatgaggtggtgaaattatgccgggaatgcctgcagaagcaggagccagtgtttgctgacacaaacctctacacgctgcggatgctgagcactgtttccgaggtcctctcctacctccaggcctttgaggaggcctcgtactatgccaggaggatggtggacggctatatgaagctctaccaccccaataatgcccaactgggcatggccgtgatgcgggcagggctgaccaactggcatgctggtaacattgaggtggggcatgggatgatctgtaaagcctatgccattctcctggtgacccatctgcgcatgttccgccagaatgagttcatgtaccacaagatgcgtgaggctgccctgaacaaccagcccatgcaggtcatggccgagcccagcaatgagccagcgccagctctgttccataagaagcaatga

SEQ ID NO: 39 - DNA, 1491 bp, Canis lupus
tgcctgagggactctgagatgacaatagggagaatggagaacgtggaggtcttcacttctgagggcaagggcagaggtctgaaggccactaaggagttctgggctgcggatgtcatctttgctgagcgggcttattccgcagtagtttttgacagccttgttaactttgtgtgccatacctgcttcaagaggcaggagaagctccatcactgtggacagtgcaagtttgcccactattgtgaccgcacctgccagaaggatgcttggctgaaccacaagaatgagtgttcggccatcaagagatatgggaaggttcccaatgagaatatcaggctggcggcccgcatcatgtggcgggtggagagagagggcaccgggctcacagagggctgcctggtcgctgtggatgacctgcagaaccacgtggagcactttggggaggaggaacaaaaggagctacggctggacgtggacactttcttgcagtactggccaccccagggccagcagttcagcatgcagtacatctcgcacatctttggcgtgattagctgcaatggcttcacactcagtgaccagagaggcctacaggcagtgggtgtgggcatcttccccaacctgggcttggtgaaccacgactgttggcccaactgcactgtcatattcaacaatggcaatcatgaggcagtgaaatccatgtttcacacccagatgagaattgagcttcgggccctgggcaagatctcagaaggagaggagctgacagtgtcctatatcgacttccttaacctcagcgaagaccgcaagaagcagctaaagaagcagtactactttgactgcacgtgtgaacactgccagaaaaagctgaaggatgacctattcctgggggtgaaagatgacccaaagccctctcaggaggtggtaaaggagatgatacaattctccaaggatacactggaaaaaatagacaaggctcgttctgagggtctgtaccatgaggtggtgaaattatgccgggaatgcctgcagaagcaggagccagtgtttgctgacacaaacctctacacgctgcggatgctgagcactgtttccgaggtcctctcctacctccaggcctttgaggaggcctcgtactatgccaggaggatggtggacggctatatgaagctctaccaccccaataatgcccaactgggcatggccgtgatgcgggcagggctgaccaactggcatgctggtaacattgaggtggggcatgggatgatctgtaaagcctatgccattctcctggtgacccatggaccctcccaccccatcaccaaggacttagaggctatgcgggtgcagacggagatggagctgcgcatgttccgccagaatgagttcatgtaccacaagatgcgtgaggctgccctgaacaaccagcccatgcaggtcatggccgagcccagcaatgagccagcgccagctctgttccataagaagcaatga

SEQ ID NO: 40 - DNA, 2146 bp, Rattus norvegicus
gcttggctcagtgtgagcgaaccaccctgggggcctgacagactctgagatgacagtaggcagcatggagaatgtggaggtctttacttccgagggcaaaggcagaggactgaaggccacgaaggagttctgggctgcggatgtcatctttgctgagagggcttattcggcagtggtttttgacagcctcattaacttcgtgtgccacacctgcttcaagaggcaggagaggctccatcgctgcgggcaatgcaagttcgcccattactgcgaccgcacatgccagaaggatgcctggctgaaccacaagaacgagtgctctgccatcaagagatacgggaaggtgcccaacgaaaatatcaggctggcagcccgcatcatgtggcgggtggagagagagggcactggactcacagagggctgcctggtgtcagtggatgacttacagaaccatgtggagcactttggggaggaggagcagaaggaactacgagtagacgtggatacattcttgcagtactggccaccacagagccagcagttcagcatgcagtacatctcacacatctttggcgtgatcaactgcaatggtttcacactcagtgaccagagagggctacaggcagtgggcgtgggcatcttccccaacctgggcctggtgaaccatgactgctggccaaactgcactgtcatattcaacaatggcaatcatgaggcggtgaaatccatgtttcacacgcagatgaggattgagctccgggccctgggcaagatctcagaaggtgaggagctgacggtgtcctacatagacttcctccacctcagcgaggagcgcaggcagcagctgaagaagcagtactactttgactgctcctgtgaacactgccagaaggggctgaaggacgacctcttcctggcagtgaaggaagaccccaagccctcccaggaggtggtgaaggagatgacacaattctcaaaggatacactggaaaaaatagacaaggctcgctctgagggtttgtatcacgaggttgtgaagctgtgtcgggagtgcctggagaagcaggaaccagtgtttgctgacaccaacctctacgtgcttcggttgctaagcattgtgtcagaagtcctctcctacctccaggcctttgaagaggcctcccattatgccaggaggatggtggatggctacatgaaactctaccaccataacaatgcccaactgggcatggctgtgatgcgggcagggctgaccaactggcatgctggtcacattgaagtagggcacgggatgatctgcaaagcctatgctattctcctggtgacccatggaccctcccaccctatcaccaaagacttagaggccatgcggatgcagacagagatggagctgcgtatgttccgccaaaatgaattcatgtaccacaaaatgcgagaggctgccctgaacaaccagcccatgcaggtcatggctgagcccagcaacgagccagccccagctctgttccataagaagcaatgaggaccttgttggagggtgggggcattgtggctgcggagctgaggaaattactactctgtgtcccccaccgccattttggttcaattcaactcagcttagttctctctcatttcagaccaactctttctctatgtgtcgggtgctagattccaccgtctatttaacaaggaagccccaaatatacttcggctagaaagaaaaatgtaaacaaacaaggtacagcataatagtaaatgccacggtgcactctatggagaggggttcagaggaggtgagtgtgtgtgagtgagtgagtgtgtgtgagtgagtgtgtgtgtgtgtgtgtgtgtgtgtgtgtgtgtgtgtgtaaaacacctgagctaagagtggcaggtacctagaatctcaggtggctgcttgtttctttgtgcaggggtctctggggctgctggtttcatctacagttacgaacatttagggttctgcagactgggatgggtgatgatgacctgtatcctgaggctgggactgttcttggccctttgagatctactcaatggtgcctagaaagaggtagggatcttgggatcctgtggtcttaatttcctaatccaagttgaagcatacttttagaataactctaga

SEQ ID NO: 41 - DNA, 2054 bp, Mus musculus
agtagcgttggggctggcgcgcgcgacgaatcttaacgctgcgccgtctgcaggcgcttccgggccgccagattccctgccttccaccctggcgccccccagccctggctctccggccgctctgccccgggcatccacgccctgcgggctcagcggattcagcgggctcaatatacgcagcacctcctccatgttgaccaagcctctgcaggggcatccttcgccccctgtgacccccacgcagcctccaggaggcaaggatcgggcagctttcgaggccgaataccgacttggccccctcctgggtaagggaggctttggcaccgtcttcgcgggacaccgcgtcacggatagacgtcaggtggccatcaaagtaatctcccggaaccgtgtgctaggctggtccaccgtgtcagactcagtcacctgcccacttgaggttgcgctgctgtggaaggtgggtgaaggcaatggccatccgggtgtgatacgccttcttgactggttcgaaacacccgaaggcttcatgctggtccttgagcggcctatgcctgctcaggatctcttcgactatatcacagagaaggggccgctgggtgaaagctgtagccgcagcttctttacccaagtcgtggcagctgtccagcactgccacgcccgtggagttgtccatcgggatatcaaggatgagaacatcctgatcgacctatgccggggttccattaaactcattgattttggttccggcgccctgcttcacgatgagccgtacactgactttgatgggacaagagtgtatagccctccagagtggatctcgcgacaccagtaccatgccctgccagcgaccgtctggtcactaggtgtcctactctatgacatggtctgtggggacattcccttcgagagagaccaggagattctggaggctgagctgcacttccctgctcatgtctccccagattgctgtgccctaatccgccggtgcctggcccctaaaccctgctcccgaccctcactggaggagattctgctggacccctggatgcaatcaccagctgaagaaaagcccatcaactcctccaaaggaagccccacccccttgccctggtccctgcttccctagacccagccaggctctctggttggaatcccatggtcacgctacagggatagatggacatctgttgacctggttatacaggttgttaaaaatccagtattactaaggtcagggaatagggatcaggggtcagaagaagatgatagccaagtctgcccagttcctatcccaattctgggaaggagctctcctcccagaacctgtggtccctaatttgggagggggagttacttgtttcttgttctgttaaagatgtttatttggttggattccttccctctgggccctaagattcttaatctgacattgtagtccctacactggcacttcctatactaccacaaaccacgtagacacttagttcaaatgctctcacttgggcaagggtgctttccttaaaattacccccatccccagcagctctttaggcaaagggccttaccctgggatctcattctgttgctgcctgcctgccttagcccagacttggtgattctgggggaggtactgctcattaattagttaatatcccacgcttccttcctttttcttcctttgtttggtgaggggaccctactgttatcccaagtgctcttattccggtgagaagaacctcacttccatgatttgggaaggaatgggagatggacatcaccggacaccaccagagactaggatgggatggatggttttggggggatgagatggaggaaataagtcttattgttgttctcctggggtcccccctttccaacttttgctgcctcctcctgagccaggattgtccagtggttgaaatgtaaataattctgtactggaggtggagagcggcaagtgccctcctgtcccttctccccctgcctggattatttaaaaagccatgtgtggaaacctatttaataaataatgaagtcacaaaaaaaaaaaaaaa

SEQ ID NO: 42 - DNA, 2101 bp, Homo sapiens
cgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaaaaaaaaaaaaaaaaaaaaaaaaaaaaaaaaaaaaaaaaaaaaaaaaa

SEQ ID NO: 43 - DNA, 2276 bp, Pan troglodytes
atgcacacccgtggcgttgatggtaggggttccccctccctggctaccagatatttccagggccctggcctcagctttccagtgaaggccgccagtcgcctggaggactccgcaggtgccgcgtccggattgatcaaagccaggtgggcggggctgtcgcccagggtgactctcccgggaggcgcgtgcccaggctcagtagcattggggctggcgcgcgcggcgaatcttaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagctccacctccatgttgaccaagcctctacaggggcctcccgcgccccccgtgacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtggcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattcccttcgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagcagaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggctttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctcctgcctggattatttaaaaagccatgtgtggaaacccactatttaataaaagtaatagaatcagaagcggctg

SEQ ID NO: 44 - DNA, 1230 bp, Canis lupus
atgttgtctttggccagcgtctcccgcggtggtgccgcgtccggattgatcaaagccaagtgggcggggctgtcgcccggggcgactctctcgggaggcgcgtgccccggctcagtagcgttggggctggcgcgcgcgtcgaatcttaacgttgcgctgtttgcgggcgcttttgggccatcagcttctttgccttccaccctggcgcccccaagtcctggctccccagcctcgctaccccgggcgtccacgccctgcgggctcagcgggctcaatctgcgcagcaccacctccatgttgactaagcctctgcaagggctccccgtggcccccgtgacccccacgccgccgccaggaggcaagaatcgcgaagcgttcgaggctgagtaccgactcggccccctccttggtaaggggggctttggtaccgtcttcgcaggacatcgcgtcacagatcgactccaggtggccatcaaagtgatcccccggaatcgtgtgttgggctggtcccccttgtcagattcagttacatgccccctggaagtggctttgctatggaaggtgggtgcaggtggtgggcaccctggcgtgatccgcctgcttgactggtttgagacaccagaaggctttatgctagtcctcgaacggcccttgcctgcccaggatctctttgactacatcacagagcagggcccattaggtgaaggccgaagccgctgcctgtttgctcaggtagtggcagctgttcgccactgccatgctcgtggagttgtccatcgtgatatcaaggatgagaacatcctgatggacctccgccggggctgtgccaaactgattgattttggttccggtgccctgcttcatgatgaaccctatactgattttgatgggacaagggtgtacagccctccagagtggatctctcgtcatcagtaccatgcactaccagctactgtctggtcactgggtatcctcctctatgacatggtgtgtggggacattccgtttgagagggaccaggagattctggaggctgagctccacttccctgcccatgtctccccagactgctgtgccctaatccgccggtgcctggcccccaaaccctctgcccgaccctcactggaggagatactgctggacccctggatgcagaccccagctgaggatgcacccctcaatacccccaaggggggtcccacccctttggcctggtccctgctgccctag

SEQ ID NO: 45 - DNA, 1800 bp, Mus musculus
ggcagcaggcgcctaggcacagtttaggtcgcgccttgctgcgctctgcagagaggagatccgactccctggtttccgcaccctctagagtcccacgccgatcgtcacctcctcggacttgggccactcagcggacccaaggagggaagggagggagaactcggcgtgggtgctggggaccccgcgttttgcgcagtgggcttacagttttgagttcccggctggtccccaccctgctttcctgctggttcgaagtctctgcggctcccctgctttgctctagtggactggagaggccatcaaaacctgggaacggacgcttcgggggggtccccagttccgctttgcttgctctctggaactttgagctgcagtttcgggtctttgtctccctttggggaagctggactgtggtttgtcagtccaggttcctgagcaggaccgcacgctgggaaccatggagttcacggcgtcgcccaagccccagctctcctctcgagccaatgccttctccatcgccgcgcttatgtccagcggcggccccaaggagaaggaggcagcagagaacaccatcaaacccctggaacaatttgtggagaaatcatcatgtgcccagccactgggtgagctgacgagtctggatgctcacgcggagtttggcggcgggggcggcagcccatcctcatcctctctgtgcacagagccactgatacccaccacccccatcatccccagcgaagagatggctaaaatcgcctgcagcctggaaacgaaggagctctgggacaaattccatgaactgggcacggagatgataatcaccaagtctggcaggaggatgttccccaccatccgcgtgtcattttctggagtggatcctgagtccaagtatatagtcctgatggacatcgtcccggtggacaacaagagataccgctatgcctaccaccggtcatcctggctggtggctggcaaagctgatcccccgctgccagccaggctctacgtgcacccagactccccctttactggcgagcagctcctcaaacagatggtgtcttttgaaaaggtgaagctcaccaacaatgaactggatcaacacggccatataattttgaattcaatgcataagtaccagccacgggtgcacatcataaagaagaaagaccacacggcctccttgctcaatctgaagtcagaagaattcaggacgttcatctttccagagacagttttcacagcagtcacagcctaccagaaccaactgataaccaagctgaaaatagacagcaatccgtttgccaaaggattccgggactcctccaggctcactgacattgagagggaatgaggtcttgttctagaaagtttaggttactcatttcaagagtgagtggttacaaaatagacccatcttccttgacatattgtcttgctttctttaccacattatggcctctttttctcctggatatacccttgctgataaaacatgatactgccacttgatgtcatctgccaaattaagaaacagcatgaagctctctccagatggatctgatcttggccctaggagagtgagcctgaatcttggatgttttgcttcttaaaaccatgagacaaatgaacatcttttctttatggagagcccagtctcaagtattctcttatagtggagaaatgtgaaggaagatgacatgactttctctgcctttcaggggacctttgaagaactgatgtgaaagaaagcatgaaacaggtgttaaaaacatttttatgccattaaacaattaaaaaatc

SEQ ID NO: 46 - DNA, 4043 bp, Mus musculus
ggcagcaggcgcctaggcacagtttaggtcgcgccttgctgcgctctgcagagaggagatccgactccctggtttccgcaccctctagagtcccacgccgatcgtcacctcctcggacttgggccactcagcggacccaaggagggaagggagggagaactcggcgtgggtgctggggaccccgcgttttgcgcagtgggcttacagttttgagttcccggctggtccccaccctgctttcctgctggttcgaagtctctgcggctcccctgctttgctctagtggactggagaggccatcaaaacctgggaacggacgcttcgggggggtccccagttccgctttgcttgctctctggaactttgagctgcagtttcgggtctttgtctccctttggggaagctggactgtggtttgtcagtccaggttcctgagcaggaccgcacgctgggaaccatggagttcacggcgtcgcccaagccccagctctcctctcgagccaatgccttctccatcgccgcgcttatgtccagcggcggccccaaggagaaggaggcagcagagaacaccatcaaacccctggaacaatttgtggagaaatcatcatgtgcccagccactgggtgagctgacgagtctggatgctcacgcggagtttggcggcgggggcggcagcccatcctcatcctctctgtgcacagagccactgatacccaccacccccatcatccccagcgaagagatggctaaaatcgcctgcagcctggaaacgaaggagctctgggacaaattccatgaactgggcacggagatgataatcaccaagtctggcaggaggatgttccccaccatccgcgtgtcattttctggagtggatcctgagtccaagtatatagtcctgatggacatcgtcccggtggacaacaagagataccgctatgcctaccaccggtcatcctggctggtggctggcaaagctgatcccccgctgccagccaggctctacgtgcacccagactccccctttactggcgagcagctcctcaaacagatggtgtcttttgaaaaggtgaagctcaccaacaatgaactggatcaacacggccatataattttgaattcaatgcataagtaccagccacgggtgcacatcataaagaagaaagaccacacggcctccttgctcaatctgaagtcagaagaattcaggacgttcatctttccagagacagttttcacagcagtcacagcctaccagaaccaactgataaccaagctgaaaatagacagcaatccgtttgccaaaggattccgggactcctccaggctcactgacattgagagggagagtgtggagagcctgatccagaagcattcctatgcccggtcacccatccgcacctatggggaagaggatgttctgggggaggagagtcaaacaactcagagtcgaggatcagcctttacaacatctgacaatttgtctctcagttcctgggtatcgtcatcttccagttttcctggatttcagcatccacagcccctgactgctcttggtaccagtacagcatccatagcgacaccgattcctcaccctatacagggttctctgccaccatatagccgcctgggaatgcctctgaccccatctgcaatagccagctccatgcagggaagtggtcccacgttcccttcattccacatgcctagataccatcactacttccagcaggggccctacgctgccatccaaggacttcgccactcctccgctgtgatgacgccatttgtatgattccactgagagtcggggaagctagatacagagtgtgcaaatggctatgaaaatacaggaggggtgggaagtagggtgggtgggaagtggggtattggagcaaggactctccaggaaacacaggacttattaaaggaaagaggagagctggactcgcaaaacacgtactcgcaagggagtgcaccacgggccgggcttcatctgtgattggatccagggaagaatcagcgtgaagtatattcagcatactcctacagctaatgggctatcagttcacccagaaagcttaataatcctagtgcttaaaagttttgttgatgcagcgctgtataaaatccgtgtgtagaggtttctttccgctttcaacaggttcagagcatcatccagaaggcaatactatatagcgtattgacaagactaactcaagcccacttctcccagtaggaaatggaagccagtcgtgatatgtttgtagtgctctactttaagcatgtttagtttcttttgtgtcagtttgcttgctgcagacggggcagagttggtgctagtacgtcctgtggtgtgaatgaatatgtggtaacacatttaccaagttcctgccatatccacaggccatgataacataaactctgtcttccatcccctctctttttttttttaaagcctaataattctttttcctgcaacaactttgcagttatgcaatgaaaaccctctacatgccattttaaaacaagaagctctctcattttcaaagaggatggcttctggggggctgcattatcaacaggctgctgacagagccaccgaggacccgtccagagcccgtgcatggtgatggctgaagctctccctcacacattcaaagtctggtgtctctcttctgagggaaatttctctgccctgggaaccaaagtcctcttcatttttcactccagcgtcagcaagtctcttgtatattaaaacacactgggccaaattctgatttttttttaaatatacatctgctttgctgctgtttccatccttgtcagggatttgccaatggccactctccatatgcatgcttcaccatgctctcatgtatgcttatgggcatgtacatgccctgtagtgggtttctccagtctgactgtattacatttacagacttcttttcattttccctggtccctaatatgaagctgcatgttaattcaatgactcccttacagaaatactaacaattcttaccggaatacaagagcttcatccagtttttcctatgttcttaagctttccttctatgtgtaaactagagtttatgttttacttctgtataaccactatgttatttttgagcaacatgtatcttagcatttacattcaggataacacatatgatattttacaatagtacatttccctaataatatagatttattaaagtccttagactttcagctttgaagacagtgtgttccacctataggatgtgaccagtttgctttatgtaggttgcctgaatttattttagtttcaatttttttttcttgtttttgttttttgagacagggtttctctgtgtaaccctggctgtcctggaaactcactctatagaccaggctggcctcgaactcagaaagcaacctgcctctgcctcccaagagctgggattaaaggcgtgcatgccaccagtgcctggcctagtttcaattttttaatgaagtttttattctactctgttcttatttcaaaagtattgactgtgcttaaagatacgggaaatctcctgacagtagaaatgtgtttaggagtaaatgccatatacttaccacatcactctgctgttttatttggtagctttaatgttaggcttttccatgcgggatgaattccaaggccaagtccagtctatgaaacaaggtaccatacccagtctgagcatgggatgctagttttaggtttttgcacttgatgttctccaccaaaagtccatagtttacttacaaagaagcatgaactgttaaggaaatgattctaaactctcatggcagacactgcaggtgagtgcagcttcttgtgtgccttgtagtagtatccacaggtagttggtttccagacaaaatacagatgtgcatttctcttaaaaacccattgtgagtggtatttaaaataaatgcccatagagcaagggtaagggcttgatatttaataattggcctcttgcaaaagaaccttggaataaagtgctactatttaaagcagg

SEQ ID NO: 47 - DNA, 1782 bp, Pan troglodytes
atgcccggatctcgggcgttaggccgcggtgatgtgtcctctcccgacagcgcgcaccgccctcccgccccgggctgcgagaccaggtggggatgtccatggctgctgcgtcagcctagtggtggcaccttttccctgaacctgtgctggggtaccgtacagccggggcgacaggccacgcgggcgccgcaccctaggcgcgccctccgcgcccggcccgcggccccgcccccggcggcggaatcaggaagcgactgtcgtcctgccgagcgccccggggcgtgcgcacccgccgtagcgctcggtgggccctctcctctccggctgccttcgaagtctctgcggctctggggctttgcggtgggggatagaggccagtgtgcagctctggagtcttcggacgaccccgtccctggccaggaccgcgtgctggggaccatggagttcacggcgtcccccaagccccaactctcctcccgggccaacgccttctccattgccgcgctcatgtcgagcggcggctctaaggagaaggaggcgacggagaacacaatcaaacccctggagcaatttgtggagaagtcgtcctgtgcccagcccctgggtgagctgaccagcctggatgctcatggggaatttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttactggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagagggaaagtgtggagagcctgattcaaaagcattcctatgcacgctcacccatccgtacctacggaggagaagaagatgtcttgggggatgagagtcagacaaccccaaatcgagggtcagcctttacaacatctgataatttgtctctcagctcctgggtatcatcttcttccagttttcctgggtttcagcacccacagtccctgactgctcttggcaccagcacagcatccatagcaacacccattcctcaccccatccagggttctctgccaccatatagccgactgggaatgcctctgaccccatcggccattgccagctccatgcaagggagtggccccacattcccttcattccacatgccacgataccatcactattttcagcaggggccctatgctgccattcaaggactacgccattcctctgctgtgatgacgccatttgtatga

SEQ ID NO: 48 - DNA, 1351 bp, Canis lupus
ggccatggagttcacggcgtcgcccaagccgcagctctcctcccgggccaacgccttctccatcgccgcgctcatgtcgagcggcggctccaaggagaaggaggccgccgagaacaccatcaaacccctggaacaatttgttgagaagtcatcctgtgcccagcccctgggcgaactgaccagcctggatgctcacggggagtttggtggtgggggcagcagtagcagcccttcctcctcctctctgtgtactgagccgctcatccccaccaccccgatcatccccagtgaggaaatggccaaaattgcctgcagcctggagactaaggagctctgggacaaattccacgagctaggaacagagatgatcatcaccaaatcgggcaggaggatgtttcccaccatccgagtatcattttccggcgtggatcctgatgccaaatacatagtcctgatggacatcgtccccgtggacaacaagaggtaccgctacgcctaccaccggtcctcctggctggtggctggcaaagcagacccgccgctgccagccaggctgtatgtacacccagactctccttttactggtgagcagctactcaagcagatggtgtcttttgaaaaggtgaaactcaccaacaatgaactggatcagcatggccatataattttgaactcaatgcacaagtaccagccacgggtgcacatcattaagaagaaagaccacacagcctcattgctcaatctgaagtctgaagaattcagaacattcatcttcccagagaccgttttcacagcagtcactgcctaccagaatcagctgataaccaagctgaaaatagatagcaacccttttgccaaaggattccgggactcctccaggctcactgacattgagagggaaagtgtggagagcctgatccagaagcattcctatgcccgctcacccatccgtacctatggaggagaagaggatgtgctgggggaggaggttcagacaacacagaatcgagggtcagcctttacaacgtctgataatttgtctctcagctcctgggtatcatcttcatccagttttcctggctttcagcacccccagtccctgactgctcttggcaccagcacagcatccatagcaacacccattcctcaccctatccagggttcattgccaccatatagccgacttgggatgcctctgacaccatcggccattgccagctccatgcagggtagtggcccgacgttcccctcattccacatgccccggtaccatcactacttccagcagggtccctatgctgctatccaaggactgcgccattcctctgctgtgatgacaccatttgtatga

SEQ ID NO: 49 - DNA, 966 bp, Canis lupus
atgtttcccaccatccgagtatcattttccggcgtggatcctgatgccaaatacatagtcctgatggacatcgtccccgtggacaacaagaggtaccgctacgcctaccaccggtcctcctggctggtggctggcaaagcagacccgccgctgccagccaggggaaggctgtatgtacacccagactctccttttactggtgagcagctactcaagcagatggtgtcttttgaaaaggtgaaactcaccaacaatgaactggatcagcatggccatataattttgaactcaatgcacaagtaccagccacgggtgcacatcattaagaagaaagaccacacagcctcattgctcaatctgaagtctgaagaattcagaacattcatcttcccagagaccgttttcacagcagtcactgcctaccagaatcagctgataaccaagctgaaaatagatagcaacccttttgccaaaggattccgggactcctccaggctcactgacattgagagggaaagtgtggagagcctgatccagaagcattcctatgcccgctcacccatccgtacctatggaggagaagaggatgtgctgggggaggaggttcagacaacacagaatcgagggtcagcctttacaacgtctgataatttgtctctcagctcctgggtatcatcttcatccagttttcctggctttcagcacccccagtccctgactgctcttggcaccagcacagcatccatagcaacacccattcctcaccctatccagggttcattgccaccatatagccgacttgggatgcctctgacaccatcggccattgccagctccatgcagggtagtggcccgacgttcccctcattccacatgccccggtaccatcactacttccagcagggtccctatgctgctatccaaggactgcgccattcctctgctgtgatgacaccatttgtatga

SEQ ID NO: 50 - DNA, 963 bp, Canis lupus
atgtttcccaccatccgagtatcattttccggcgtggatcctgatgccaaatacatagtcctgatggacatcgtccccgtggacaacaagaggtaccgctacgcctaccaccggtcctcctggctggtggctggcaaagcagacccgccatgctcaactcctgagctgtatgtacacccagactctccttttactggtgagcagctactcaagcagatggtgtcttttgaaaaggtgaaactcaccaacaatgaactggatcagcatggccatataattttgaactcaatgcacaagtaccagccacgggtgcacatcattaagaagaaagaccacacagcctcattgctcaatctgaagtctgaagaattcagaacattcatcttcccagagaccgttttcacagcagtcactgcctaccagaatcagctgataaccaagctgaaaatagatagcaacccttttgccaaaggattccgggactcctccaggctcactgacattgagagggaaagtgtggagagcctgatccagaagcattcctatgcccgctcacccatccgtacctatggaggagaagaggatgtgctgggggaggaggttcagacaacacagaatcgagggtcagcctttacaacgtctgataatttgtctctcagctcctgggtatcatcttcatccagttttcctggctttcagcacccccagtccctgactgctcttggcaccagcacagcatccatagcaacacccattcctcaccctatccagggttcattgccaccatatagccgacttgggatgcctctgacaccatcggccattgccagctccatgcagggtagtggcccgacgttcccctcattccacatgccccggtaccatcactacttccagcagggtccctatgctgctatccaaggactgcgccattcctctgctgtgatgacaccatttgtatga

SEQ ID NO: 51 - DNA, 883 bp, Mus musculus
ggaaactgttgggttggatccaataggaagtgtctcttctcagccacgccttcgcccaatcagccatcctaactgggccacgcccaaagagcaaccgacagtgtccatatacctgcctggtcccacctccactggagagcctaaagcaacatgcctcccaagaaacccgagcctaagaaggagactgccaagccggctgcagcccctgctccagctgcatccgcagctccggagcccctcaaggactctgcctttgacccaaagagtgtgaagatagacttcagtgctgaccagatcgaagaattcaaagaggccttttcattgtttgaccggactccaacgggagagatgaagatcacctacgggcagtgtggggacgtgctgcgggccctgggccagaaccccaccaacgcagaggtgctgcgcgttttgggcaaacccaagcctgaagagatgagttccaagacactggacttcgagatgttcctgcccatcctgcaacacatctcccgcaacaaggagcagggcacctatgaggacttcgtggaggggctgcgggtctttgacaaagaaagcaacggcacagtcatgggtgcagagcttcggcatgtccttgctaccctgggagagaagatgagcgaggcagaggtggagcagctgttgtctgggcaggaggatgccaatggctgcatcaactatgaagcctttgtcaagcacatcatgtctgggtaaagcacgtttctccagggtgcttggccctgcgtgagaaagcaagagatccacagcggctgttactgttacggagtattggactcacatggcttctctgacccacaaccttccctggaaataaagagccccagcttggagtttcattaatccc

SEQ ID NO: 52 - DNA, 934 bp, Homo sapiens
ctctctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgaaaaaaaaaaaaaaaaaaaaaaaaaaa

SEQ ID NO: 53 - DNA, 855 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctga

SEQ ID NO: 54 - DNA, 1293 bp, Pan troglodytes
atctcatctcccagacgccacgtctcttggtttcttcttagatcactcctctgccaaagatcccaacaagacaacatggctcccaagaagcctgagcctaagaaggaggcagccaagccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaagatcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgagtgcagcctctccctcctggtcccttccggggtcacataaggccttaagaataacaccacgtgccctagaaggcatctgccccagccctgaccccttaagaggaaacctcttgggatcaggcagtgaggacagccctgctcactcaccatctcctgtctcctgcctgcccttgcctgttcaccctgtcttgacctatcagtcacatcctcttgcctctcccaggatctctcaaggcaatgcccttccctcaggcctggggcctcctgtacaggctcctgggagtgagaaagctgatcccaagtggaagagaaggtccctggcctgtgctctggaccctgttcttcctcacttctttccctaggttttccctgggatctccctgggtgtggtaaggggctgggtataggagggtgaaatgccctttccacctagcactttctttcaggtgcttggcccttggctttagccataccagggtgagttaaagagaggccctggatgggtgagctgagatggagtcctcgacttatcaccacaccactgccccaaggaccttacaggccctccctgttaataaacagctctaacacggccaggctgggctctgggattctga

SEQ ID NO: 55 - DNA, 810 bp, Canis lupus
acatctcttgattctgtcctagctcccacctccaccggagatcccagcaagacaacatgcctcccaagaagcccgagcctaagaaggaagcagccaaggctgccccagcccctgcccctgccccagctcctgaaccccccaaggaacctgcctttgatcccaagagtgtaaagatagacttcactgctgaccagattgaagagttcaaagaggctttctcgttgtttgaccggacaccgactggagagatgaagatcacctatgggcagtgtggagacgtactgcgggcactgggccagaaccccaccaatgccgaggtgctgcgtgtcctgggcaagcccaagcctgaagagatgaatgccaagatgctggactttgagacgttcctgccaatcttgcagcacatctcccgcaacaaggaacagggcacctatgaggactttgtggaggggctgcgtgtgtttgacaaggagagtaatgggacagttatgggtgctgagcttcgccatgtccttgccaccctgggagagaagatgactgaggccgaagtggagcagctgttggccgggcaagaggatgccaatggctgtatcaattacgaagcctttgtcaaacacatcatgtctgggtgaagcagactcgtccagggtgcctggcccttggcctcagcctttctggggcaagtgaagcaagaagcccagaataactgagctggagctaaggttctggactcattgcatgcagccctgagggcatcccaggcccatagccctccctgtaaataaacagtcctggcaaggttctgggcca

SEQ ID NO: 56 - DNA, 650 bp, Canis lupus
catctcttgattctgtcctagctcccacctccaccggagatcccagcaagacaacatgcctcccaagaagcccgagcctaagaaggaagcagccaaggctgccccagcccctgcccctgccccagctcctgaaccccccaaggaacctgcctttgatcccaagagtgtaaagatagacttcactgctgaccagattgaaggtgagtactgacaaccccaccttccctagcatgcctgctgttgtactttccaggaggaggaggactgagaggagtggttgctatctccaggttaatagtaatcaccgttctcatcattactaacttgtatttgccaaaggttttctgtttgcttcttttcatctaacctatgttatcacataagcgctttatgtggattaactcaattctcaccacacccccaggaggtagggactattaccacccccattgactgataaaactgaggcacaggttcagtagtttgcccaatctcatgcaggcagttgttagtagagcagaactctaactcaggaaatccgattgcagacgtgaattctcaactatcctgccagactgcctgagacataatagatgcacaacaaaaatgtctttttcttccctctacccacaaaatctactattcaagat

SEQ ID NO: 57 - DNA, 599 bp, Mus musculus
agtcagaccgccacagatcatggccagtaggaaggctgggacccgaggcaaggctgcagccaccaagcaggcacaacgtggctcttctaatgtcttctcaatgttcgaacaagcccagattcaggaattcaaggaagccttcagctgcattgaccagaacagggatgggatcatctgcaaatcagacctgaaggagacctattcccagctcgggagggtaagtgttccggaggaagagctggacgccatgctgcaggaagggaagggtcccatcaacttcaccgtcttcctcacactcttcggggagaagctcaatgggacggaccccgaggaagccatcctgagtgccttccgcatgttcgaccccagcggccagggggtggtgaacaaggaagagttcaagcagcttctcatgacccaggcagacaagttctctcctgctgaggtagagcaactgtttgcgctgacacccatggacctggccggcaacattgactacaagtctctctgctacatcatcacccacggggatgagaaagaggagtagacaggctgaggtcacctcaataaactctgtgcctgaactagaaaaaaaaaaa

SEQ ID NO: 58 - DNA, 619 bp, Homo sapiens
tctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaaaaaaaaaaaaaaaaaaaaaaaa

SEQ ID NO: 59 - DNA, 612 bp, Pan troglodytes
gacagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtattgaccagaatcgtgatggcatcatctgcaaggcagacctgagggagacctactcccagctggggaaggtgagtgtcccagaggaggagctggatgccatgctgcaggagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 60 - DNA, 577 bp, Rattus norvegicus
attacaggccagtaggaaggctgggacccggggcaaggctgcagccaccaagcaggctcaacgtggctcttccaatgtcttctcaatgttcgagcaagcccagattcaggaattcaaggaagccttcagctgcattgaccagaacagagacggaatcatctgcaagtcagacctgaaggagacttattcccagctcgggagggtaagtgtcccagaggaggagctggatgccatgctgcaagaggggaagggccccatcaacttcaccgtcttcctcacgctcttcggggagaaactcaatgggaccgaccctgaggaggccatcctgagtgctttccgaatgtttgacccgagcggccagggagttgtgaacaaggaggagttcaagcagcttctcatgacccaggcagacaagttctctcctgctgaggtggagcagctgttcgccctgacacccatggacctgacaggcaacatcgactacaagtctctctgctacatcatcacccacggggatgagaaagaggagtagagacacactggggtcacctcaataaactctgtgcctgaactgaac

SEQ ID NO: 61 - DNA, 610 bp, Mus musculus
acacttgcttttgcacacttgagatcatctccaagcttctatacctcacaccatggttcacttcacagctgaggagaaggcagctatcacaagcatctgggataaagtggacttggaaaaagttggaggagaaactctgggaaggctcctgattgtttacccatggactcagagattctttgacaagtttggaaacctctcttctgccctggccatcatgggaaacccccggattagagcccatggcaagaaagtgctgacatccttgggcttgggggttaagaacatggacaacctcaaggagacctttgctcatctcagtgagctgcactgtgacaagcttcatgtggatcctgagaacttcaagctcctgggcaacatgttggtgattgtcctttctactcattttgccaaggaattcaccccagaggtgcaggctgcctggcagaagctggtgattggagtggccaatgctctgtcccacaagtaccattaaactccattccagtacactggcaatcccatgtgtctatgatgccctctttgagtccatggggactgcattgagagcacaaattttgtttaataaaattgattcttaataacattg

SEQ ID NO: 62 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 63 - DNA, 1156 bp, Pan troglodytes
cctcactggagctacagacaagaaggtaaaaaaggctgacaaaagaagtcctggtatcttctatggtgggagaagaaaactagctaaagggaagaataaattagagaaaaattggaatgactgaatcggaacaaggcaaaggctataaaaaaaattaagcagcagtatcttcttgggggccccttccccacactatctcaatgcaaatatctgtctgaaacggtccctggctaaactccacccatgggttggccagccttgccttgaccaatagccttgacaaggcagacttgaccaatagtcttagagtatccagtgaggccaggggccggcggctggctagggatgaagaataaaaggaagcaccctccagcagttccacacactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaggtcaaggcacatggcaagaaggtgctgacttccttgggagatgccataaagcacctggatgacctcaagggcacctttgcccagctgagtgaactgcactgtgacaagctgcatgtggatcctgagaacttcaggctcctgggaaatgtgctggtgaccgttttggcaatccattttggcaaagaattcacccctgaggtgcaggcttcctggcagaagatggtgactgcagtggccagtgccctgtcctccagataccactgagcctcttgcccatgattcagagctttcaaggataggctttattctgcaagcaatacaaataataaatctattctgctgagagatcacacatgattttcttcagctcttttttttacatctttttaaatacatgagccacaaagggtttatattgagggaagtgtgtatgtgtatttctgcatgcctgtttgtgtttgtggtgtgtgcatgcttctcatttatttttatatgagatgtgcattttgatgagcaaataaaagcagtaaagacacttgta

SEQ ID NO: 64 - DNA, 540 bp, Canis lupus
atgactctttttgaaatcaactcaaaagaattggccttgagctttacagaagaactttgtggtttaagagtgatcaccagcaagttcccagacaccatggtgcattttactgctgaggagaaggctgctgttattagcctgtgggccagggtgaatgtggagttggttggaggcgaggtcctgggaaggctcctggttgtttatccatggacccagaggttctttgacaattttggcaatttgtcctctgagtctgcaataatgggcaaccccaaggtcaaggcccatggcaagaaggtgctgacttcctttggaaatgctattaaacatatggatgacctcaaggacacctttgctgagctaagtgaactgcactgtgacaagctgcatgtggatccggagaacttcaagcttctaggcaacatgatattgattgtcttggcaactcacttcagcaaggagtttactccccaaacacaggctgcgtggcagaagctgacaactgctgtggctaatgctctggcacacaagtaccactag

SEQ ID NO: 65 - DNA, 444 bp, Rattus norvegicus
atggttcacttcacagctgaggagaaggctgctatcataagcatatgggaaaaagtggacttggaaaaaattggaggagaaaccctgggaaggctcctgattgtttacccatggactcagagattctttgacaaatttggaaacctctcttctgctctggccatcatgggtaacccccggatcagagcccatggcaagaaagtgctgacgtctctaggttcggcagttgagaacatggacaacctcaaggagacctttgctcatctgagtgagctacactgtgacaagcttcatgtggatcctcagaacttcaagctcctgggcaacatgttggtgattgtcctttctactcattttgccaaggaattcaccccagaggtgcaggctgcctggcagaagctggtgatgggtgtggccaatgctctgtcccacaagtaccattaa

SEQ ID NO: 66 - DNA, 569 bp, Mus musculus
gacacttctgattctgacagactcaggaagaaaccatggtgctctctggggaagacaaaagcaacatcaaggctgcctgggggaagattggtggccatggtgctgaatatggagctgaagccctggaaaggatgtttgctagcttccccaccaccaagacctacttccctcactttgatgtaagccacggctctgcccaggtcaagggtcacggcaagaaggtcgccgatgctctggccaatgctgcaggccacctcgatgacctgcccggtgccctgtctgctctgagcgacctgcatgcccacaagctgcgtgtggatcccgtcaacttcaagctcctgagccactgcctgctggtgaccttggctagccaccaccctgccgatttcacccccgcggtgcatgcctctctggacaaattccttgcctctgtgagcaccgtgctgacctccaagtaccgttaagctgccttctgcggggcttgccttctggccatgcccttcttctctcccttgcacctgtacctcttggtctttgaataaagcctgagtaggaagaaaaaaaaaaaa

SEQ ID NO: 67 - DNA, 575 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggc

SEQ ID NO: 68 - DNA, 576 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtggccatgcttcttgccccttgggcctccccccagcccctcctccccttcctgcacccgtacccccgtggtctttgaataaagtctgagtgggcggc

SEQ ID NO: 69 - DNA, 556 bp, Rattus norvegicus
acattctccttctgatagactcaggaagcaatcatggtgctctctgcagatgacaaaaccaacatcaagaactgctgggggaagattggtggccatggtggtgaatatggcgaggaggccctacagaggatgttcgctgccttccccaccaccaagacctacttctctcacattgatgtaagccccggctctgcccaggtcaaggctcacggcaagaaggttgctgatgccttggccaaagctgcagaccacgtcgaagacctgcctggtgccctgtccactctgagcgacctgcatgcccacaaactgcgtgtggatcctgtcaacttcaagttcctgagccactgcctgctggtgaccttggcttgccaccaccctggagatttcacacccgccatgcacgcctctctggacaaattccttgcctctgtgagcactgtgctgacctccaagtaccgttaagccgcctcctgccgggcttgccttctgaccaggcccttcttccctcccttgcacctatacctcttggtctttgaataaagcctgagtaggaagc

SEQ ID NO: 70 - DNA, 545 bp, Rattus norvegicus
acattctcattctgatagactcaggaagcaatcatggtgctctctgcagctgacaaaaccaacatcaagaactgctgggggaagattggtggccatggtggtgaatatggcgaggaggccctacagaggatgttcgctgccttccccaccaccaagacctacttctctcacattgatgtaagccccggctctgcccaggtcaaggctcacggcaagaaggttgctgatgccctggccaaagctgcagaccacgtcgaagacctgcctggtgccctgtccactctgagcgacctgcatgcccacaaactgcgtgtggatcctgtcaacttcaagttcctgagccactgcctgctggtgaccttggcttgccaccaccctggggatttcacacctgccatgcacgcctctctggacaaattccttgcctctgtgagcaccgtgctgacctccaagtaccgttaagccacctcctgtcgggcttgccttctgaccaggcccttcttccgtcccttgcacctgtctttgaataaagcaaaagtaggaag

SEQ ID NO: 71 - DNA, 5143 bp, Mus musculus
attttagcaccacggcagcaggaggtttcgactaagttggagggaacggtccacgattgcatgcctgcgcccgccaggtgatacctccgctggtgacccaggggctctgcaacacaaggagtctgcatgtctaagtggtagacatgctcagctttgtggatacgcggactctgttgctgcttgcagtaacttcgtgcctagcaacatgccaatatttgcaatcgggatcagtacgaaagggccccactggagacagaggaccacgtggacaaaggggtcccgcaggtccccgaggcagagatggtgttgatggtcccatgggccctcctggtccccctggctcccctggtcctcccggctcccctgccccccctggtcttactgggaactttgctgctcagtattctgacaaaggagtttcatctggccctggaccaatgggtttaatgggacccagaggccctcctggtgctgttggagcccctggccctcaaggtttccaaggacctgctggtgaacctggtgagcctggtcaaacgggtcctgcaggtccccgtggtccagctggctctcctggcaaggctggtgaggatggtcaccctggaaaacccggaagacctggggagagaggagtcgttggaccacagggtgctcgtggtttccccgggactcctggacttcctggcttcaaaggcgtgaaaggacacagtggtatggatggattaaagggacagcctggtgcacagggtgtgaagggtgaacccggtgcccctggagagaatggaactccaggtcaagcaggagcccgagggcttcctggtgagagagggcgtgtcggagctcctggtccagctggtgcccgaggcagtgatggaagcgttggccccgtcggccctgctggtcccattgggtctgctggaccccctggtttcccaggtgctcctggtcccaagggtgaacttgggcccgttggtaaccctggccctgctggtcctgctggtccccgtggtgaagtgggtcttccaggtctttctggccctgttggacctcctggcaaccctggaacaaatgggctcactggcgccaagggtgctactggactccctggtgtcgctggggctcccggtctccctggcccccgtggtattcctggccccgctggtgctgctggtgctacaggtgccagaggacttgttggtgagcctggtcctgctggctccaaaggagaatccggtaacaagggtgagcctggctctgttggagcccaaggtcctcctggtcccagcggtgaagaaggaaagagagggtctcccggagaagctggatctgctggccctgcagggcctccagggcttagaggcagccctggttctcgaggtcttcctggagctgatggcagagctggtgtaatgggtcctcctggcaatcgtggttcaaccggccctgctggaatccgaggtcctaatggagatgccggtcgacctggggaacctggtctcatgggacccagaggtcttcctgggtctcctggaaatgttggcccatctggtaaagaaggccctgtgggtctccctggcattgatggcagacctggcccaatcggcccagctggaccaagaggtgaagctggcaacatcggattccctggacccaaaggcccctctggtgatcctggcaaacctggtgagagaggacaccccggtcttgctggtgctcggggagctccaggacccgatggcaacaatggagctcagggcccccctggaccccagggtgttcaaggtggcaaaggtgaacaaggccctgctggtcctcctggcttccagggtctccctggtccctcaggtactactggagaagttggcaagcccggagaaaggggtcttcctggtgaattcggtctccctggtcctgctggtccaagaggagaacgtggtaccccgggtgagagtggagctgctggcccttctggtcctattggaagccgaggtcccagtggagccccagggcctgatggaaacaagggtgaagctggtgcagtcggtgctccaggcagtgctggtgcctctgggcctggtgggcttccaggagagaggggtgctgctggcatacctgggggcaaaggagaaaagggtgaaactggtctccgaggtgacactggcaacactggtagagatggtgctcgtggcattcctggtgctgtaggtgcccctggtcctgctggggcctcaggtgaccggggtgaagctggtgctgccggtccttctggcccagctggtcctcggggtagccctggtgaacgtggtgaagttggccctgctggccccaatggatttgctggtcctgctggtgctgctggccaacccggtgctaaaggagagaagggaaccaaagggcctaagggtgaaaatggcattgttggtccaaccgggtctgttggagctgctggcccatctggtcctaatggcccacctggtcctgttggaagtcgtggtgatggagggccccctggtatgactggcttccctggtgctgctggacggactggtccccccggacccagtggtattgctggcccccctggcccccctggtgctgctggaaaggaagggattcgtggtccccgtggcgaccaaggtccagttggccgaactggagaaacaggtgcatctggaccccctggatttgttggtgaaaagggtccctctggagaacctggtaccgcaggagcccctggtaccgcaggtcctcagggtcttcttggtgctcccggtattctgggtctccctggctctagaggtgaacgtggtctgccaggtattgctggtgctctgggtgaacctggtcctctgggcatctcaggccctcctggtgcccgtggtccccctggtgctgtgggcagccctggagttaatggtgcccctggtgaagctggtcgtgatggtaaccctggcagcgatggtcccccaggtcgtgatggtcagcctggacacaagggagagcgtggttaccctggcagcattggtccgactggtgctgcaggtgcccctggtcctcacggttctgtgggtcctgctgggaaacatggaaaccgaggtgaacctggtcctgccggttctgttggtcctgttggtgctgttggtccaagaggtcctagtggtcctcaaggcatccgaggtgacaaaggagaacctggtgataaagggcacaggggtcttcctggcttaaaaggatacagtggattgcagggtcttcctggtcttgctggcctacatggtgaccaaggagctcctggtcctgtgggtcctgctggtcccaggggtcctgctgggccttctggacccgttggcaaagatggtagatctgggcaacctggcccagtcgggcctgctggtgttcgtggttctcagggtagccaaggtcccgctggtccccctggtccccctggacctcctggtcctcctggtgtcagcggaggtggctatgactttggttttgaaggagacttctacagggctgaccagcctcgctcccagccttcactcagacccaaggactatgaagttgatgcaactctgaaatctctcaataaccagattgagacccttctcactcctgaaggctctagaaagaaccctgctcgcacgtgccgggacttaagactcagccacccagagtggaacagcgattactactggattgaccctaaccaaggatgtactatggatgccatcaaagtgtactgtgatttctctactggtgaaacctgcatccaggcccaacctgtaaacaccccagcgaagaactcatacagccgcgcccaggccaacaagcatgtctggttaggagagactatcaatggtggcagccagtttgaatacaacgtagaaggggtgtcctccaaggaaatggcaactcagctcgccttcatgcgcctgctagccaaccgtgcttctcagaacatcacctaccactgcaagaacagcattgcgtacctggatgaggagacgggcagcttgaacaaggctgtgcttctgcagggttccaacgatgttgaacttgttgctgagggcaacagcaggttcacctactctgtcctagtcgatggctgctccaaaaagacaaatgaatggggcaagacaatcattgaatacaaaacaaataagccatctcgcctgccgttccttgacattgcacctctggacattggtggtgctgaccaagaattccgtgtggaggttggccccgtctgtttcaaataagtgaactcaacctaaattaaaaaccaaaaacccctgaaaaaactttctctttgccgtttcctcctttaaaaaaaaaaacaaaaaacaaaaactgaaagctgaatccttccatgtcttctatgcatctacatcttaaactgtgggcaaaagagaaggattggtcagagcagtgtgcaatatgatccaactaagtctcctcccttggcccctccccaaaatgtttgcagtgttatttttgtgggtttttttttaacaccctgacacctgttgtggacattgtcaacctttgtaagaaaacccaaataaaaattgaaaaataaaataaaaagaaacccatgaacattcgcaccacttgtggcttctgactatcttccacagagggaagtttaaaacccaaacttccaaaggtttgaactacctcaagacactttgcagtgagtgtagaccatcccaatgagagttgaccaaggctgacacgaactgaggtacttgttttgttttgcttgcaacacaaaggtgctaattagtagtatttcagatacttgaagaatatgaacggtgctggaagaattacagaagaaacaatcctccacattgatgtgcattgtgtgtgatttttaaatttgacttagcagtcctctttctcatcttatccccaactacaggaatgcaggccacttgccccaggttctctcttcattagattcagcattcattctttaacagcctcattttccttcttgcccatggttccaaagaagtcttgtttcttggacaagcagaaaaattgaattgtacctattttgtatatgtgagatgtttaaataaattgtgaaaaataaaataaagcatttttggttttccaaaagaaaatattgagt

SEQ ID NO: 72 - DNA, 5411 bp, Homo sapiens
gtgtcccatagtgtttccaaacttggaaagggcgggggagggcgggaggatgcggagggcggaggtatgcagacaacgagtcagagtttccccttgaaagcctcaaaagtgtccacgtcctcaaaaagaatggaaccaatttaagaagccagccccgtggccacgtcccttcccccattcgctccctcctctgcgcccccgcaggctcctcccagctgtggctgcccgggcccccagccccagccctcccattggtggaggcccttttggaggcaccctagggccagggaaacttttgccgtataaatagggcagatccgggctttattattttagcaccacggcagcaggaggtttcggctaagttggaggtactggccacgactgcatgcccgcgcccgccaggtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccagaggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctcctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtccccctggtcctccaggcttccagggtctgcctggcccctcaggtcccgctggtgaagttggcaaaccaggagaaaggggtctccatggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtaggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccaggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgctcctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccaggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggcgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggtgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatat

SEQ ID NO: 73 - DNA, 5030 bp, Pan troglodytes
gaggcaccagagaaagtgatacctccgccggtgacccaggggctctgcgacacaaggagtctgcatgtctaagtgctagacatgctcagctttgtggatacgcggactttgttgctgcttgcagtaaccttatgcctagcaacatgccaatctttacaagaggaaactgtaagaaagggcccagccggagatagaggaccacgtggagaaaggggtccaccaggccccccaggcagagatggtgaagatggtcccacaggccctcctggtccacctggtcctcctggcccccctggtctcggtgggaactttgctgctcagtatgatggaaaaggagttggacttggccctggaccaatgggcttaatgggacctagaggcccacctggtgcagctggagccccaggccctcaaggtttccaaggacctgctggtgagcctggtgaacctggtcaaactggtcctgcaggtgctcgtggtccagctggccctcctggcaaggctggtgaagatggtcaccctggaaaacccggacgacctggtgagagaggagttgttggaccacagggtgctcgtggtttccctggaactcctggacttcctggcttcaaaggcattaggggacacaatggtctggatggattgaagggacagcccggtgctcctggtgtgaagggtgaacctggtgcccctggtgaaaatggaactccaggtcaaacaggagcccgtgggcttcctggtgagagaggacgtgttggtgcccctggcccagctggtgcccgtggcagtgatggaagtgtgggtcccgtgggtcctgctggtcccattgggtctgctggccctccaggcttcccaggtgcccctggccccaagggtgaaattggagctgttggtaacgctggtcctgctggtcccgccggtccccgtggtgaagtgggtcttccaggcctctccggccccgttggacctcctggtaatcctggagcaaacggccttactggtgccaagggtgctgctggccttcccggcgttgctggggctcccggcctccctggaccccgcggtattcctggccctgttggtgctgccggtgctactggtgccaggggacttgttggtgagcctggtccagctggctccaaaggagagagcggtaacaagggtgagcccggctctgctgggccccaaggtcctcctggtcccagtggtgaagaaggaaagagaggccctaatggggaagctggatctgccggccctccaggacctcctgggctgagaggtagtcctggttctcgtggtcttcctggagctgatggcagagctggcgtcatgggccctgctggtagtcgtggtgcaagtggccctgctggagtccgaggacctaatggagatgctggtcgccctggggagcctggtctcatgggacccagaggtcttcctggttcccctggaaatatcggccccgctggaaaagaaggtcctgtcggcctccctggcatcgacggcaggcctggcccaattggcccagctggagcaagaggagagcctggcaacattggattccctggacccaaaggccccactggtgatcctggcaaaaacggtgataaaggtcatgctggtcttgctggtgctcggggtgctccaggtcctgatggaaacaatggtgctcagggacctcctggaccacagggtgttcaaggtggaaaaggtgaacagggtcccgctggtcctccaggcttccagggtctgcctggcccctcaggtcccactggtgaagttggcaaaccaggagaaaggggtctccacggtgagtttggtctccctggtcctgctggtccaagaggggaacgcggtcccccaggtgagagtggtgctgccggtcctactggtcctattggaagccgaggtccttctggacccccagggcctgatggaaacaagggtgaacctggtgtggttggtgctgtgggcactgctggtccatctggtcctagtggactcccaggagagaggggtgctgctggcatacctggaggcaagggagaaaagggtgaacctggtctcagaggtgaaattggtaaccctggcagagatggtgctcgtggtgctcctggtgctgtgggtgcccctggtcctgctggagccacaggtgaccggggcgaagctggggctgctggtcctgctggtcctgctggtcctcggggaagccctggtgaacgtggtgaggtcggtcctgctggccccaatggatttgctggtcctgctggtgctgctggtcaacctggtgctaaaggagaaagaggagccaaagggcctaagggtgaaaacggtgttgttggtcccacaggccccgttggagctgctggcccagctggtccaaatggtccccccggtcctgctggaagtcgtggtgatggaggcccccctggtatgactggtttccctggtgctgctggacggactggtcccccgggaccctctggtatttctggccctcctggtccccctggtcctgctgggaaagaagggcttcgtggtcctcgtggtgaccaaggtccagttggccgaactggagaagtaggtgcagttggtccccctggcttcgctggtgagaagggtccctctggagaggctggtactgctggacctcctggcactccaggtcctcagggtcttcttggtgcccctggtattctgggtctccctggctcgagaggtgaacgtggtctaccaggtgttgctggtgctgtgggtgaacctggtcctcttggcattgccggccctcctggggcccgtggtcctcctggtgctgtgggtagtcctggagtcaacggtgctcctggtgaagctggtcgtgatggcaaccctgggaacgatggtcccccgggtcgcgatggtcaacccggacacaagggagagcgcggttaccctggcaatattggtcccgttggtgctgcaggtgcacctggtcctcatggccccgtgggtcctgctggcaaacatggaaaccgtggtgaaactggtccttctggtcctgttggtcctgctggtgctgttggcccaagaggtcctagtggcccacaaggcattcgtggtgataagggagagcccggtgaaaaggggcccagaggtcttcctggcttaaagggacacaatggattgcaaggtctgcctggtatcgctggtcaccatggtgatcaaggtgctcctggctccgtgggtcctgctggtcctaggggccctgctggtccttctggccctgctggaaaagatggtcgcactggacatcctggtacagttggacctgctggcattcgaggccctcagggtcaccaaggccctgctggcccccctggtccccctggccctcctggacctccaggcgtaagcggtggtggttatgactttggttacgatggagacttctacagggctgaccagcctcgctcagcaccttctctcagacccaaggactatgaagttgatgctactctgaagtctctcaacaaccagattgagacccttcttactcctgaaggctctagaaagaacccagctcgcacatgccgtgacttgagactcagccacccagagtggagcagtggttactactggattgaccctaaccaaggatgcactatggatgctatcaaagtatactgtgatttctctactggcgaaacctgtatccgggcccaacctgaaaacatcccagccaagaactggtataggagctccaaggacaagaaacacgtctggctaggagaaactatcaatgctggcagccagtttgaatataatgtagaaggagtgacttccaaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatctcgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaatcgtgggcaaaagagaaaaagaaggattgatcagagcattgtgcaatacaatttcattaactccttcccccgctcccccaaaaatttgaattttttttcaacactcttacacctgttatggaaaatgtcaacctttgtaagaaaaccaaaataaaaattgaaaaataaaaaccatgaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaagaacatattga

SEQ ID NO: 74 - DNA, 4560 bp, Canis lupus
agcaccaaggcggcaggagggttcagctaagttggaggtactggccacgactgcatgcctgcgcccgccaggtgatacctccgccggtgacccaggggctctgcgacacaaggagtctgcatgtctaagtggtagacatgctcagctttgtggatacgcggactttgttgctgcttgcagtaacttcgtgcctagcaacatgccaatctttacaggaggcaactgcaagaaagggcccaactggagatagaggaccacgtggagaaaggggtccaccaggaccaccaggcagagatggtgacgatggtatcccaggccctcctggtccacctggtcctcctggcccccctggtcttggcgggaactttgcagcccagtatgatggaaaaggagttggccttggccctggaccaatgggtttgatgggacctagaggtccacctggtgcatctggcgctcctggccctcaaggtttccaaggacctgctggtgagcctggtgaacctggtcaaactggtccagcgggtgctcgtggtccacctgggcctcctggcaaggctggtgaggatggtcaccctggaaaacctggacgacccggtgagagaggagttgttggaccacagggtgctcgtggtttccctgggactcctggacttcctggtttcaagggcattaggggacacaatggtctggatggattgaagggacagcccggtgctccaggcgtgaagggtgaacctggtgcccctggtgaaaatggaacgccaggtcaaacaggagcccgtgggcttcctggtgagagaggacgtgttggtgcccctggtccagctggtgcccgtggaagtgatggaagtgtgggtcctgtgggtcctgctggtcctatcgggtctgctggccctccaggcttcccaggtgctcctggccccaagggtgaaatcggacctgttggtaaccccggtcctgctggtcccgcgggtccccgtggtgaagtgggtcttccaggtgtttccggccccgttggaccccctggtaaccctggagccaacggcctgactggtgctaagggtgctgctggcctgcccggtgtcgctggggctcctggcctccctggaccccgtgggattcctggtcctgttggtgccgctggtgctactggtgccagaggaattgttggtgagcctgggccagctggttccaaaggagaaagtggcaacaagggtgagcctggctctgctggtgcccaaggtcctcctggtcccagtggtgaagaaggaaagagaggccccaatggtgaagctggatctgctgggccctctggacctcctgggctgagaggaagtcctggttctcgtggtcttcctggagctgatggcccagctggtgtcatgggtcctcccggccctcggggtgccaccggccctgctggtgtccgcggtcccaatggagattctggtcgccctggagagcctggcctcatgggaccccgaggttttcctggtgcccctggtaatgttggcccagctggtaaagaaggtcccatgggtctccctggtattgatggcaggcctggaccaattggcccagcgggagcaagaggagagcccggcaacatcggattccctggacccaaaggccccactggtgatcctggcaaaaatggtgataaaggtcatgctggtcttgctggtgctcggggtgctccaggtcctgatggaaacaatggtgctcagggacctcctggaccacaaggtgtccaaggtggaaaaggtgaacagggtcctgctggtcctccaggcttccagggtctgcctggccccgcaggtacagctggtgaagttggcaaaccaggagaaaggggtctccctggtgaatttggtcttcctggtcctgctggtccaagaggggagcgtggtccccctggagaaagtggtgctgctggtccttctggtcctattggaagccgaggtccttctggaccccctgggcccgatggaaacaagggtgaacctggcgtgcttggcgccccgggcaccgctggcgcgtccggtcccggtggactcccaggagagaggggtgctgccggcattcctggaggcaagggagaaaagggtgaaaccggtctcagaggcgaaattggtaacccaggcagagatggcgcccgtggagctcctggtgccatgggtgcccctggtcctgccggagccactggtgaccggggtgaagctggtcctgccggtcccgctggccctgctggtcctcgtggtacccctggtgaacgtggtgaggttggtcccgctggccccaatggatttgctggtcctgctggtgctgctggtcaacctggtgctaagggagagagaggaaccaaagggcccaagggtgaaaatggccccgttggtcccacaggccccattggatctgccggcccatctggtccaaatggtccccctggtcctgctggaagtcgtggtgatggtggcccccctggtgctactggtttccctggtgctgctgggcggactggtcctcctggaccctctggtatcactggccctcctggtccccctggtgctgctggtaaagaaggactccgtgggcctcgaggtgaccaaggtccagttggccgaacgggagaaacaggtgcctctggtccccctggctttactggtgagaagggtccctctggagagcctggtaccgctggacctcctggcacaccaggtcctcaaggtctccttggtgctcctggcattctgggtctcccaggctctcggggtgagcgtggtctaccaggtgttgctggatccgtgggtgaacccggacctcttggcattgctggtccacctggggctcgtggtcctcctggagctgtgggtgcgcctggagtcaacggtgctcctggtgaagctggtcgtgatggcaaccctgggaatgatggtcccccaggccgcgatggtcaagccggacacaagggagagcgtggttaccctggcaacattggtcccgttggcgctgtgggtgcacctggtcctcatggccctgtgggtcccactggcaaacacggaaaccgtggtgaacctggtcctgctggttctgttggtcccgtcggcgctgttggtccaagaggtcctagtggcccacaaggtattcgaggtgataagggagagcctggtgagaaggggcccagaggtcttcctggcttaaagggacacaatggactgcaaggtcttcctggtcttgctggtcaacatggcgatcaaggtgcacctggttctgtgggtcctgctggtcctaggggtcctgctggtccttctggccctgctggcaaagatggtcgcactgggcaacctggtacagtcggacctgctggcattcgtggctctcagggtagccaaggtcctgctggccctcctggtccccctggccctcctggccctcctggcccaagtggtggtggctatgactttggttatgaaggggacttctacagggctgaccagcctcgctcaccaccttctctcagacccaaggactatgaagttgatgctactctgaaatccctcaacaaccagattgagacccttcttactcctgaaggctctaggaagaacccagctcgcacatgccgagacctgagactcagccacccagagtggagcagtggttactactggattgaccctaaccaaggatgcactatggatgctatcaaagtatactgtgatttctctactggcgaaacctgcattcgggctcaacctgaaaacatcccagccaagaactggtacagaaactccaaggtcaagaagcacatctggttaggagaaactatcaatggtggtacccagtttgaatataatgttgaaggagtaaccaccaaggaaatggctactcaactcgccttcatgcgcctgctggccaaccatgcctctcaaaacatcacctaccactgcaagaacagcattgcctatatggatgaggagactggcaacctgaaaaaggctgtcattctgcaaggttccaatgatgttgaactggttgccgagggcaacagcaggttcacctacactgttcttgtagacggctgctctaaaaagacaaatgaatggagaaagacaatcattgaatacaaaacaaataagccatcccgcctgcctatccttgatattgcacctttggacatcggtgatgctgaccaagaattcagggtggacgttggcccagtctgtttcaaataaatgaactcaacctaaattaaaaaaaaaaaagaaatctgaaaaaactttctctctttgccatttctttttcttcttttttttttaactgaaagttgagtccttccatttcctctgcacatctacttgcttaaattgtgggcaaaagagaaggagaaggattgatcagagcatagtgcaatacgatttcattcattccccctccctgcccccaaaaatttggaattttttttcaacactcttacatccgttgtggaaaatgtcaacctttgttagaaaaccaaaataaaaattgaaaaataaaataaaaaccatgaacatttgc

SEQ ID NO: 75 - DNA, 4474 bp, Rattus norvegicus
atgctcagctttgtggatacgcggactctgttgctgcttgcagtaacgtcgtgcctagcaacatgccaatctttacaaatgggatctgtacggaagggccccactggagacagaggaccgcgtggacaaaggggcccagcaggtccccgaggcagagatggtgttgatggtcccgttggccctcctggtccccctggtgcccctggcccccctggtccccctggcccccctggtcttactgggaactttgctgctcagtattctgacaaaggagtttcagctggccccggaccaatgggcttaatgggacccagaggccctcctggtgctgtcggagcccctggccctcaaggtttccaaggacctgctggtgagcctggtgagcccggacaaacgggtcctgcaggttcccgtgggccagctggccctcctggcaaggccggtgaagatggtcaccctggaaaacctggaagacctggcgagagaggagtcgttgggccacaaggtgctcgtggtttccctgggactcctggacttcctggcttcaaaggcattcgaggacacaacggtctggatggattgaaaggacagcctggtgcccagggtgtgaagggtgaacccggtgcccctggagagaatggaaccccaggtcaagcaggagcccgagggcttcctggtgagagagggcgtgtcggagctcctggtccagctggtgcccgtggcagtgatggcagtgttggccccgtcggccctgctggtcccattgggtctgctggtcctcctggtttcccaggtgctcctggtcccaagggtgaacttgggcctgttggtaaccctggccctgctggtcctgctggtccccgtggtgaagcgggtcttccgggtctttctggccccgttggacctcctggcaaccctggagcaaatggcctcactggtgccaagggagccactggactccctggtgttgctggggctcctggtctccccggtccccgtggtattcctggccccgttggtgctgctggtgccactggtcccagaggacttgttggtgaacctggtcctgctggctccaaaggagagactggtaacaagggtgagcctggctctgctggagcccaaggtcctcctggtcccagcggtgaagaaggaaagagagggtcccctggagagcctggatctgctggtcctgcagggcctccagggctgagaggcagccctggttctcgaggtcttcctggagctgatggcagagctggtgtgatgggccctcctggcaatcgtggttcaactggccctgctggagtccgaggtcctaatggagatgccggtcgccctggagaacctggtctcatgggacccagaggtcttcccgggtctcctggaaatgttggcccagctggtaaagaaggccctgtgggtctccctggcatcgatggcagacctggcccaattggcccagctggaccaagaggtgaagctggcaacatcggattccctggacccaaaggcccctctggtgatcctggcaaacctggtgagaaaggccatcccggtctcgctggtgctcggggagctccaggtcccgacggcaacaatggtgctcagggccctcctggacctcagggtgttcaaggtggcaaaggtgaacagggccctgctggtcctccaggcttccagggtctcccgggtccctctggtaccgctggagaagttggcaagccgggagaaaggggtcttcccggtgaattcggtctccctggtcctgctggtccaagaggagaacgtggtcccccaggtgagagtggagctgctggtccttctggtcctattggaatccgaggtccctctggagccccagggcctgatgggaacaagggtgaagctggtgcagtcggtgctccaggctctgctggtgcctctggtcctggtgggcttccaggagagaggggtgctgctggcatacctggaggcaaaggagaaaagggtgaaactggtctcagaggtgaaatcggcaaccctggtagagatggtgctcgaggtgctcctggtgctataggtgcccctggtcccgctggagcctcaggtgaccggggcgaagctggtgctgctggtccttctggccctgctggtcctcgaggtagccctggtgaacgtggtgaggttggtcctgctggccccaatggatttgctggtcctgctggttctgctggccaacctggtgctaaaggagaaaagggaaccaaagggcctaagggagaaaatggcatcgttggtccaaccggacctgtcggagctgctggcccatctggtcctaatggcccacctggccctgctggaagtcgtggtgatggagggccccctggtatgactggcttccctggtgctgctggacggactggtccccccggacccagtggtattactggcccccctggtccccctggtgctgctggtaaagaaggtattcgtggtccccgtggtgaccaaggtccagttggccgaactggagaaataggtgcatctggtccccctggatttgctggcgagaagggtccttctggagaacctggtaccacaggaccccctggcactgcaggtcctcagggtcttcttggtgctcccggtattctgggtctccctggctctcgaggtgaacgtggccagccaggtattgctggtgctctgggtgaacctggtcctctgggcattgcaggccctcctggggcccgtggtccccctggtgctgtgggcagtcctggagttaatggtgcccctggtgaagccggtcgtgatggtaaccctggcagtgatggtcccccaggtcgtgatggtcaacccggacacaagggagagcgtggttaccctggcaacattggtcccactggtgctgcaggtgctcctggtcctcatggttctgtgggtcctgctgggaaacatggaaaccgtggtgagcctggtcctgctggttctgttggtcccgttggtgctgtcggtccaagaggtcctagtggccctcaaggtattcgaggtgacaagggagagcctggtgacaaaggggccagaggtcttcctggcttaaaaggacacaatggattacagggtcttcctggtcttgctgggctgcatggtgaccaaggagctcctggtcccgtgggtcctgctggtcccaggggtcctgctggtccttctggccccattggcaaagatggtagatctggacatcctggaccagtcggtcctgctggcgttcgtggctctcagggtagccaaggtcccgctggtccccctggtccccctgggcctcctgggcctcctggtgtcagcggaggaggctatgactttggtttcgaaggaggcttctacagggctgaccagcctcgctcacagccttcactcagacccaaggactatgaagttgatgcaactctgaaatctctcaataaccaaatcgagacccttctcactcctgaaggctctagaaagaaccctgcccgcacatgccgtgacttaagactcagccacccagagtggaagagcgattactactggattgaccctaaccaaggatgcactatggatgccatcaaagtgtactgcgatttctctactggtgaaacctgcatccaggcccaacctgtcaacaccccagccaagaatgcatacagccgtgcccaggccaacaagcatgtctggttaggagagaccatcaatggtggcagccagtttgaatacaacgcagaaggggtgtcctccaaggaaatggcaactcagctcgccttcatgcgcctgctagccaaccgtgcttctcagaacatcacctaccactgcaagaacagcattgcgtacctggacgaggagacaggccgcctgaataaggctgtcattctgcagggctccaacgacgtcgaacttgttgctgagggcaacagcagattcacctacactgtccttgtcgatggctgctccaaaaagacaaatgaatgggacaagacagtcattgaatacaaaacgaataagccatctcgcctgccattccttgacattgcacctctggacatcggtggtactaaccaagaattccgtgtggaggttggccctgtctgtttcaaataagtgaactcaacctaaattaaaaaacaaaaacccctgaaaaaaactttctctttgccatttcttcctttaaaaaaaaaaaaaaaactgaaagctgaatccttccgtgttttctatgcacctacatcttaaactgtgggcaaaagagaaggattggtcagagcagtgtgcaatatgatccagataagtcccctccctcaggccctccccaaaacgtttgcagtgttatttctgtgggtttttttttaaacactctgacacctgttgtggacattgtcaacctctgtaagaaaacccaaataaaattttaaaaataaaataaaaagaaacccatgaacatttgcaccaaaaaaaaaaa

SEQ ID NO: 76 - DNA, 597 bp, Mus musculus
caggccagtcttgagtgcactcaactccagcgcagcctccaaccctcaccaccaccaccaccatgtctctgatgaagaatgagagagctatcatcatgtccatgtgggagaagatggctgctcaggccgagcccattggcactgagactctagagaggctcttctgcagctacccccagacgaagacctacttcccccacttcgacctgcaccatgggtctcagcagttgcgggcccacggcttcaagatcatgaccgccgtaggggatgcggttaagagcatcgacaacctctctagtgctttgactaagctgagcgagctgcatgcctacatcctgcgtgtggatccggtcaacttcaagctcctgtcccactgtctgctggtcacaatggccgcacgctttcccgccgacttcacccctgaggtccacgaagcctgggacaagttcatgtctatcctgtcttctatcctgactgagaagtaccgctaagcctccaccgccacgacccccatgaccagctatgatccctctcctcccctttattgaaccctccctcaggtctttccctgaatccctaataaatggttgaagaagg

SEQ ID NO: 77 - DNA, 589 bp, Homo sapiens
accaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacggccgaggcccacgccgcctgggacaagttcctatcggtcgtatcctctgtcctgaccgagaagtaccgctgagcgccgcctccgggacccccaggacaggctgcggcccctcccccgtcctggaggttccccagccccacttaccgcgtaatgcgccaataaaccaatgaacgaagc

SEQ ID NO: 78 - DNA, 703 bp, Pan troglodytes
ttgtcactggatctgataagaaacaacacccctgcagccccctcccctcacctgaccaatggccacagcctggctgggcccagctccctgtatataaggggaccctggggcaagagcactaccaaggccagtcctgagcaggcccaactccagtgcagccgcccaccctgccgccatgtctctgaccaagactgaggggaccatcattgtgtccatgtgggccaagatctccacgcaggccgacaccatcggcaccgagactctggagaggctcttcctcagccacccgcagaccaagacctacttcccgcacttcgacctgcacccggggtccgcgcatttgcgcgcgcacggctccaaggtggtggccgccgtgggcgacgcggtgaagagcatcgacaacatcggcggcgccctgtccaagctgagcgagctgcacgcctacatcctgcgcgtggacccggtgaacttcaagctcatgtcccactacatgctggtcaccctggccgcgcgcttccccgccgacttcacggccgaggcacacgccgcctgggacaagttcctatcggtcgtatcctctgtcctgaccgagaagtaccgctgagcgccgcctccgggacccccaggacaggctgcggcccctcccctgcccttctccctcccacagttcctgccctgactccaataaatggatgaggacgga

SEQ ID NO: 79 - DNA, 28 bp, Artificial Sequence
  Description of Artificial Sequence: Synthetic primer
ccggtaccgagaatattttacaccgcgc

SEQ ID NO: 80 - DNA, 30 bp, Artificial Sequence
  Description of Artificial Sequence: Synthetic primer
ccggtaccaggggaaaataatcccaggaat

SEQ ID NO: 81 - DNA, 29 bp, Artificial Sequence
  Description of Artificial Sequence: Synthetic primer
ccggtacccttggagaatctaggctgatg

SEQ ID NO: 82 - DNA, 29 bp, Artificial Sequence
  Description of Artificial Sequence: Synthetic primer
ccggtaccgttggagaggctcctggcctg

SEQ ID NO: 83 - DNA, 28 bp, Artificial Sequence
  Description of Artificial Sequence: Synthetic primer
ccggtacctctgaatgtcactgaatagc

SEQ ID NO: 84 - DNA, 28 bp, Artificial Sequence
  Description of Artificial Sequence: Synthetic primer
ccggtaccacttctggtatatcctgaag

SEQ ID NO: 85 - DNA, 30 bp, Artificial Sequence
  Description of Artificial Sequence: Synthetic primer
ccggtaccgtcacactcaaactataacaac

SEQ ID NO: 86 - DNA, 28 bp, Artificial Sequence
  Description of Artificial Sequence: Synthetic primer
ccggtaccgctgcctattgtcatctcag

SEQ ID NO: 87 - DNA, 28 bp, Artificial Sequence
  Description of Artificial Sequence: Synthetic primer
ccggtaccatggcaactaatgccgaatg

SEQ ID NO: 88 - DNA, 28 bp, Artificial Sequence
  Description of Artificial Sequence: Synthetic primer
ccggtaccgtgttctgctgagcaggtgc

SEQ ID NO: 89 - DNA, 30 bp, Artificial Sequence
  Description of Artificial Sequence: Synthetic primer
ccggtacctaccggctaaagcctggatttg

SEQ ID NO: 90 - DNA, 28 bp, Artificial Sequence
  Description of Artificial Sequence: Synthetic primer
ccggtaccggacgagggagtgcggagcc

SEQ ID NO: 91 - DNA, 28 bp, Artificial Sequence
  Description of Artificial Sequence: Synthetic primer
cccaagcttacaacttcattagaataag

SEQ ID NO: 92 - DNA, 27 bp, Artificial Sequence
  Description of Artificial Sequence: Synthetic primer
cccaagcttagccagcctgcctgtgtg

SEQ ID NO: 93 - DNA, 30 bp, Artificial Sequence
  Description of Artificial Sequence: Synthetic primer
cccaagctttcctcaattaggtcctcctgc

SEQ ID NO: 94 - DNA, 29 bp, Artificial Sequence
  Description of Artificial Sequence: Synthetic primer
cccaagcttctcaccaagggtctggctgg

SEQ ID NO: 95 - DNA, 28 bp, Artificial Sequence
  Description of Artificial Sequence: Synthetic primer
ccggtaccggctcccaagggagtcccag

SEQ ID NO: 96 - DNA, 28 bp, Artificial Sequence
  Description of Artificial Sequence: Synthetic primer
ccggtacccatgctctctgatttgtgag

SEQ ID NO: 97 - DNA, 31 bp, Artificial Sequence
  Description of Artificial Sequence: Synthetic primer
ccggtaccattttcatgtacacctaggttag

SEQ ID NO: 98 - DNA, 26 bp, Artificial Sequence
  Description of Artificial Sequence: Synthetic primer
ccggtacccccaacgtactgagccgg

SEQ ID NO: 99 - DNA, 31 bp, Artificial Sequence
  Description of Artificial Sequence: Synthetic primer
gatctcgaggcaactatgctgactggccagt

SEQ ID NO: 100 - DNA, 31 bp, Artificial Sequence
  Description of Artificial Sequence: Synthetic primer
gatctcgagaatcaaccattcttgaggcctg

SEQ ID NO: 101 - DNA, 1820 bp, Homo sapiens
gcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgtacaatggatgcattgaaattatatgtaattgtataaatggtgcaacagtaataaagttaaacaattaaaaagaaaaaaaaaaaaaaaaaaaaaaaaa

SEQ ID NO: 102 - DNA, 2172 bp, Pan troglodytes
atgatcccctccctggtgtctgtaggaacaggttatgcttccctggagcaagttatgcaggcaattaaaaatgacaatggaattcagtttataaccaatgaaatccagctttgcgagcatgaaagcgatccaaacacagccagagggcgccaaaatgccgcaaataaaagttccaaaggcgtcaactggcgtttgcgggaaggtaagcaaagtgaacgcatcttcctaccccggtggctattctgtgtcccggtgctaaaccaagtgtccgccccccagggcaccggacaagccgcggttggccctagctttgactcgagcgctcgcgattccgagagcatcctccgaggggcgacgtctctcgcccgaccagctggacctcggcgaccgcgcctcccccgaagctgcagccttcggggctcagccccgcgggtgcgggtgcaggtgcggagccgcccaaggtgcgcagccgcccaaggtgcgcaactcgtttgcagcggcgcagcccagacgcgcctgcagctggggctcaccccaacctcgctgcccgccgagaactccaagatgggaggcaagctcagcaagaagaagaagggctacaatgtgaacgacgagaaggccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctccgcagaagagcccaagccggtggaggccccggcagctaattccgatcaaaccgtagccgtgaaagagtgacaaggacagcctataggaaaaaataataccacttaaaacaatctcctctctctctctctttctctctctatctcctctctctctctctctcctctcctatctctcctctctctctctcctatactaacttgtttcaaatgggaagtaatgatatgtattgcccaaggaaaaataaaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaagtctgcgttcattgcagttccagtttctcttccattctgtgtcacagacaccaacacaccactcattggaaaatggaaaaaaaaaacaaaaaaacaaaaaaatgtacaatggatgcattgaaattatatgtaattgtataaatggtgcaacagtaataaagttaaacaattaaaaagaagtaa

SEQ ID NO: 103 - DNA, 822 bp, Canis lupus
atgggaggtaagctgagcaagaagaagaaggggtacaacgtgaacgatgagaaggccaaggacaaggacaagaaggccgaaggggcggggaccgaagaggagggaaccccgaaggagagcgagccccaggcggccgccgagagcgccgaggtgaaggagggcaaggaggagaaggccgacaaggacgggcccgacgcggccgccaagcccgaagacaaggaaggcgacaaagacacggcggcggccaaggaagacgccccgaaggcggagcccgagcccacggaggcggagggggcggccgacggcaaggccgagcccccccagaaggccgaggccgagccggcggccggcgacgccccccaggccgcggagcccgagccggcgacccaggccgcggccgcggcgggggagcagggccaggagcccggggaacccgcaaagactgaggctcccgcagctcccggcgcgcaggagacgaaaagcgacggggccccggcttcagactcaaaacccagcagcggcggcagcagcagcgccgaggcggccccgtccagcaaggagagcccggcggccacggcggcccaggcccagagctcggccgcggcccaggcccagagctcggccgccgcccccggcgcccccgcggacgacgcgccccctgccggccacgccgagcaagccgtcgcgctggccgactgactcgacggccggccgactgactcgacggccggccgggccgccgcctgtgtccccccctgtgtctctcccctctgtctctctctcctctactaactcgtttcacatcggaagtaatgatatgta

SEQ ID NO: 104 - DNA, 1809 bp, Bos taurus
ggcgagggcggcggcggcagcagcgcgacagctcgctcctcgctccgggctccccgccgtcgagccggggagagagcctcccgcccagcggccaggcacccggccggacgacgcccagcgacccgggcccctaccgcggcaccgcgttcacctaggggcggccacaggcacccagacccgaactccaagatgggaggcaaactgagcaagaagaagaaggggtacaatgtgaatgatgagaaggccaaggacaaagacaagaaggctgaaggggctgggacagaagaggagggaaccccaaaggagaatgaggcccaggctgctgccgagaccccagaggtgaaggagggcaaagaggagaagccggagaaggatgcccaggacaccaccaagcccgaagacaaggaaggcgagaaagatgccgaggcagccaaggaagatgccccgaaggcagagcctgagccgacggagggggccgagggcaagccagagccccccaaagatgctgagcaggagccggcggctgcctcaggcccctccactggcggcgacgcccccaaagcttcggaggctgaggcagcagagcctgcggcccccaccaaggatgacaagagcaaggagggaggggacgccacaaagactgaggctcccgccgctcctgccgcgcaggagacgaaaagtgacggggccccagcttcagactcaaaacccagcagcactgaggctgccccatcctccaaggagacgccggcagccacggaagcgccgagttccacgcccaaggctcaggcccccgcagcccccgcagacgaggtcaaacctgccgagaccccggcagctaattccgatcaaaccgtagcagtgaaagagtaacaaaggacagcctatggaaagaaagaaaaaagaatacagcttaacgacgacctgtctctcttgtctctctctctctctctctgtctctctctctcctatactaacttgtttcaaatcggaagtaatcatatgtattgcccaagaataaggatgtggtcccatcaaagggagggagggggtggggagaatccaaatagtatttttgtggggaaatatctaatataccttcagtcaactctaccaatcagccctggattttcaagatcaatgtctgaaagtgcagtacatcttttgtacctgaactgctgtcacacgcgctcctgccactaagatctgaacatcttgtctttctgcaaggggcggggggtggggagtgaggcgtttgattctgcccgcagggctgtgccaaggcaatcagatgtttatgaaagcagtattttctgtgttttctttttcatttacagcttttcttattttgatatttttttaatgttgtggatgaatgccaactttcagacagcccaccgtagcctgtccacatgtatcttgatgccaatactccatttttcctcccccggtctttttgggaataacaaacattctctcatcctacttagcctccctagatttctcatgacgagttaatgcatgtccgtggttgggtgcacctgtagttctgtttattggtcagtggaaatgaaaaaaaataaataaaaaaagtctgcgttcattgcagttcgttttctcttccattctgtgtcacagacaccaacacaccactcattggaaaatggaaaaacataaaaattaaaaaaaaaacaaaaacaaaaaaaaatgtacaatggatgcattgaaattatatgtaattgtataaatggtgcaacagtaataaagttaaacaattaaaatgaaaaaaaaaaaaaaaaaaaaaaaaaa

SEQ ID NO: 105 - DNA, 681 bp, Mus musculus
atgggaggcaagctgagcaagaagaagaagggctacaatgtgaacgacgagaaggccaaggacaaagacaagaaggccgaaggcgcgggcaccgaggaggaggggaccccgaaggagagcgaaccccaggcggccgccgacgccaccgaggtcaaggagagcacggaggagaagcccaaggacgcggcggacggcgaggccaaggcagaggagaaggaggccgacaaggcagcggcggccaaggaggaggcgcccaaggccgagcccgagaagagcgagggcgccgcggaggagcagcccgagcccgcgccggcgcccgagcaggaggcggccgcgcccgggcccgctgcgggcggcgaggcccccaaggccggcgaagcgagcgccgagagcacgggcgcggccgacggcgcggccccggaggagggcgaggccaaaaagactgaggctcccgccgccgccggccccgaggcgaaaagcgacgcggccccggcggcttcagactctaaacctagcagcgcggagcccgcgccctcgtccaaggagacgcccgccgcctccgaggcgcccagttccgcggccaaggcccccgcgcccgccgcgcccgcagccgccgagccccaggccgaggcacccgccgccgccgccagctccgagcaaagcgtggccgtcaaagagtaa

SEQ ID NO: 106 - DNA, 1024 bp, Rattus norvegicus
gggggctgcagcggcggcggcagtagcggcagcggcggcggcggcggcggcagcgctccaactcgctccacgctccggctccgccgtcgagccgggagagagagagcctttgctgagcggccaggcactcggccggacgacaccagacacccgggccccttggaggcaccgcgctcacccagggccggcacagcgacccaaagccgaactccaagatgggaagcaagctgagcaagaagaagaagggctacaatgtgaacgacgagaaggccaaggacaaagacaagaaggctgaaggcgcgggcaccgaggaggaggggacccagaaggagagcgaaccccaggcggccgccgacgccaccgaggtcaaggagagcgcggaggagaagcccaaggacgcggcggacggcgaggccaaggcggaggaaaaggaggccgacaaggcggcggccaaggaggaggcgcccaaggccgagcccgagaagagcgagggcgccgcggaggagcagcccgagcccgcgccggcgcccgagcaggaggcggccgcgcccgggcccgctgcgggcggcgaggcccccaaggccggcgaggcgagcgcggagagcacgggcgcggccgacggcgcgccccaggaggagggcgaggccaaaaagactgaggctcccgccgccggccccgaagcgaaaagcgacgcggccccggcggcttcagactctaaacctagcacggagcccgcgccctcgtccaaggagacgcccgcggcctccgaggcgcccagttccgccgccaaggcccccgcgcccgccgcgcctgccgccgagccccaggccgaggcacccgtcgccagctccgagcaaagcgtggccgtcaaagagtaaccgggacagcctagccagaaccgacgccactcgcaaacgacctgtctcacgctctctctgtctctcactctgtcctctctctgtctctctatcctatactaacttgtttcaaattggaagtgaggatatgtattgcccaagggatt

SEQ ID NO: 107 - DNA, 2459 bp, Homo sapiens
cgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaacggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtaaaaaaaaaaaaaaaaaaaaaaaaaaaaaaaaa

SEQ ID NO: 108 - DNA, 2931 bp, Pan troglodytes
atgatcaatcaactccgggcaccagaatccggagaaagcttggcagttagggttacttatacctatgggtgggacgtaggtgtagggctacatcttagccttgtcttttccgattgggccatggcgttatttaatattgctgaaaattacatgcgcaaagaaaaccaagaccaattgtacagcgccctgaatctgtcatttcacctgcgtcgtcccggacgccatttggctgttgacgtggttccgagccagcaaataacgccagcagccctcccagatccacgccggcccgtctctccgccggccccctcctcgcagtgctttctcctgcagctcccctgggctccgcggccagtagtgcagcccgtggagccgcggctttgcccgtctcctctgggtggccccagtgcgcgggctgacactcattcagccggggaaggtgaggcgagtggaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgtggggcactggctgcctgcgggtggctcctgggcgccgaagcccaggagcctggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaatatcagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctctctgccaatctccatggaggagaccttgtggccaattatccatatgatgagacgcggagtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaatggtggtgcttggtacagtgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcggctccaggctatctggcagtaacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgcttaaatctatctatataatgtagtatgatgtaatgtggtcttttttttagattttgtgcagttaatacttaacattgatttattttttaatcatttaaatattaatcaacattccttaaaataaatagcctcttaggtaaaaatataagaacttgatatatttcattctcttatatagtattcattttcctactatattacacaaaaaagtatagaaaagatttaaataattttgccatcctaggcttaaatgcaatattcctggtattatttacaatgcagaactttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaaatccccagtgcgtgtatttcagttctctaagatttttggtctggcattgtggtcttatgatgaaaacatgtatcctcttaatggcggcttctcatatattcatcctgtacattttaaaatttgttaagcgactactgtgtgctaagcactgcatagcctctatgtatgttattgtggcaggcaaaagcttctgattttgggcacaacctttatataaatcacacaaaaattaa

SEQ ID NO: 109 - DNA, 1865 bp, Canis lupus
atgtcattgatttttgctcttttaggtgagcctgaatttaaatacattgggaatatgcacgggaacgaggctgtgggacgggaactgcttatcttcctggcccagtacctgtgcaacgagtaccagaagggcaacgagacgatcgttaagctgatccacagcacccggatccacatcatgccttccctcaacccggacggctttgagaaggccgcatctcagcctggtgagctcaaggactggtttgtgggtcgaagcaatgcccagggaatagatctgaaccggaactttccagacctggataggatagtttatgttaatgagaaagaaggtggtccgaataatcatctgttgaaaaatctgaagaagattgtggatcagaacacaaagcttgctcctgagaccaaggcagtcattcattggattatggatattcctttcgtgctctctgccaatctccacgggggagacctcgtggccaactacccctatgatgagacccggagtggtagtgcccatgaatatagctcctgcccggatgatgccattttccaaagcttggctcgggcgtactcctcttttaacccacccatgtctgaccccaaccggcccccgtgtcgcaagaatgatgacgacagcagcttcatagatggaacaaccaacggtgctgcttggtatagtgtacctggcggaatgcaggacttcaactacctcagcagcaactgcttcgagatcaccgtggagctgagctgtgaaaagttcccgcctgaagagagcctgaggagctactgggaggataacaagaactccctggtccgctacctcgagcagatacaccggggagttaaaggctttgtgcgcgaccttcaggggaacccgatcgccaacgcaaccatctccgtggaaggaatagaccacgacgtcacatctgcaaaggatggtgattactggcgattgcttgtacctggaaactataagctcacagcctcagctccaggctatctggcaaccacaaagaaagtagcagttccttacagccctgctgttggggttgattttgaactggagtcattttctgaaaggaaagaagaggaaaaggaagaattgatggaatggtggaaaatgatgtcagaaactttaaatttctaaagaagcttctaagtagctgcttttaatcaatctatattatatagtatgatgtaacgtggccattttcttttagattttgtgcaatatttaacattgatttattttgtaatcatttaaatattaatagatactacttaaaaacaattagacttttaggtaaaatgtaagaacttggtctgtttcttctcatataacattgattttcgtacgtatattaatcatggaggactgtagaaaaagtttaagcgatcttgccgttttagacttaaatgcaatatttcacatgctatttacaatgcagagattttttttgagtaattctagcctttaaaaatgaacgaagtccttctaatgttaattggtgacgctgccgcatagtgagtgccactgagaaggtcaacagctgcagcttggagttgtgggcaccatacaccgcaagactttgatacttcagtgtgaattgccacttgtcttgtgctgactagctacacgagcatgatcttgttaatgcattttttggatgggaaggaaacgtaaatgtttaggaagaggctttatgataaggatggaaagcgacttcttgcttgtacatacgggggctatactgctatattatttagcctgttaacactgtttaaaagtttaaggattttctcttggttgtagattggtctagaattgcattctgaatgaataaaagttaaaaaaaaaaaaaa

SEQ ID NO: 110 - DNA, 2103 bp, Mus musculus
gtgaggcgagaggaggctggtgctgagctcgccaactccacccgggcccgggcagacaaaagaggccggcagtgcagctcgcggggacgcgatggccgggcgcggaggacgggtgctgctggcgctgtgtgccgcgctggtggccggcgggtggctgctgacggctgaagcccaggagcccggggcgccagcggctggcatgaggcgccgccggcggctccagcaagaggacggcatctccttcgagtaccaccgctatccagagctgcgcgaggcgctggtgtccgtatggctgcagtgcaccgccatcagcagaatctacacagtggggcgcagcttcgagggccgggagctcctggtcatcgagctgtctgacaaccccggggtccatgagccgggtgaacctgaatttaaatacattgggaacatgcatggtaatgaggcggttggacgggaactgcttattttcttggcccagtacctgtgtaacgagtaccagaaaggcaatgagacaattgtcaacctgatccacagcacccgaattcatatcatgccctccttgaaccccgacggctttgagaaagccgcatcgcagcccggcgagctgaaggactggtttgtgggccgcagcaacgcccagggaatagatctgaaccgtaacttcccagacctggacaggatcgtgtatgttaatgagaaagaaggcggtcctaacaatcacctgctgaagaatctgaagaaaattgtggaccaaaattcaaagcttgcccccgagaccaaggctgtcattcactggatcatggacattccatttgtgctttctgccaatctgcacggaggagaccttgtggctaattacccatatgatgagacacggagcggtactgctcacgaatacagttcctgccctgatgacgcaattttccaaagcttggctcgcgcgtactcttctttcaacccagtcatgtctgaccccaatcgacctccctgtcgcaagaatgacgatgacagcagctttgtagatggaacgaccaatggtggtgcatggtacagcgtccccggtggaatgcaagacttcaattacctgagcagcaactgcttcgagatcactgtggagcttagctgtgagaagttcccaccggaagagactctcaaaagctactgggaagataacaaaaactccctcatcagctacctggagcagatacaccgaggtgttaaagggtttgtccgtgaccttcagggtaacccgattgccaacgcaaccatctctgtggacgggatagaccatgatgtcacctcggctaaggatggggattactggcgattgcttgctcctggaaactataaacttacagcctccgctcctggctacctggcaatcacaaagaaagtggcagttccttttagccctgctgttggggtggactttgagcttgagtctttctctgaaaggaaggaggaggagaaggaagaattgatggagtggtggaaaatgatgtcagaaactttgaatttttaagaaaggcttctaactaattgctttaatctatctatagactgtagtaagatgcaatgtggctcttttcttttaggttgtgtgcagttgatatttaacattgatttatttttgatcatttaagtaatagttagtaatcacgtaaatacacccggacagaaatataatgtctggatctacttcattcttacatcaacattcactttaaaatctatcgaagctcttttaacgtaatgggtgacaatgtcacatgacagatgccatgaagaagtcaaccgatatagcttggatctgtgaaccctgtactgcgagaatcacatagttccatataagttgtccttagtctcttgtgctgattcactgtataagcatgatcctggtaatgcactttggatgggaagaaaatgtacgtgcttttcagaggggctctgaacagaatgaaaacctagttcttgcgtgtactttgaagaatggaattgtattagtcagcctgttaatgccacttcagagtttggggttttgtcttgattgtagattggcccagaattgcattctgatgaataaaggcaaaaaaaaaaaaaaaa

SEQ ID NO: 111 - DNA, 3840 bp, Homo sapiens
gtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 112 - DNA, 3877 bp, Homo sapiens
tgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 113 - DNA, 3678 bp, Homo sapiens
agatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaaaaaa

SEQ ID NO: 114 - DNA, 2730 bp, Pan troglodytes
atggggccagaggccctgtcatctttactgctgctgctcttggtggcaagtggagatgctgacatgaagggacattttgatcctgccaaatgccgctatgccctgggcatgcaggaccggaccatcccagacagtgacatctctgcttccagctcctggtcagattccactgccgcccgccacagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgatggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctcggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggtcagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaatgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtga

SEQ ID NO: 115 - DNA, 3619 bp, Canis lupus
atggggccaggggccctctcatctctactgctgctgctgctgctgctactcttagtggcaactggagatgctgatatgaagggacattttgaccctgccaagtgccgctatgccctgggcatgcaggacaggaccattccagatggggacatatctgcctccagctcttggtcagactccactgctgcgcgccacagcaggctggagagtagcgacggggatggggcatggtgccccgcagggccagtctttccaaaggaggaggagtacctgcaggtggatctgcggcggctgcacctggtggctttggtgggcacccaggggcggcatgctggaggcctgggcaaggagttctcccccagctaccggttgcgttactcccgggacggccaccgctggatggactggagggaccgctggggtcaggaggtgattttaggtaatgaggaccctgggggagtggtgctgaaggacctcggaccccccatggtggcccggctggttcgcttttacccccgggctgaccgggtcatgagtgtctgtctgcgggtggagctctatggctgcctctggaaggatggactcctgtcttacacggcccccgtggggcagacgatgtacttgtcccaggcagtacacctcaacgactccacctatgatgggcacaccacacacactgttggcgggttgctgtacggaggtctggggcagctggcagatggtgtggtggggctggatgactttaggaagagccaggaactgcgggtctggccaggctatgactatgtgggatggagcaaccacagcttcctgggtggctacgtggagatggagtttgagtttgaccggctcagggctttccaggccatgcaggtccactgtaacaacatgcacaccctgggagcccgcctgcctggtggggtggaatgtcgcttcaagcggggccctgccatggcctgggagggggagcctgtgcgccatgccctggggggcagcctgggggaccccagagcccgggctgtgtcagtgcccctgggcggccgtgtgggccgctttctgcagtgccgcttcctctttgctgggccttggttactcttcagtgaaatctccttcatctctgatgttgtaaatgattcctctccagctctggtgggcactttcccaccagctccctggtggccacctggtccacctcccaccaacttcagcagtttggagctggagcctagaggccagcagcctgtggccaaggctgaggggagcccaactgccatcctcattggctgtctggtggccatcatcttgttgctgctgctcatcattgccctcatgctctggcggctgcactggcgccggctcctcagcaaggccgagcgccgggtgttagaagaggaactgacagttcatctctctgtcccgggagacaccatcctaatcaacaaccgcccaggccctcttgagccacccccctaccaagagccccgacctcgtgggaatccaccccactctgctcccagtgtccccaatggctctgcgttgctgctctccaatccagcctaccgcctccttctggccacttacgcccgtccccctcggggccctggcccccccacacccgcctgggccaaacccaccaacacccaggcctgcagtggggactatatggagcctgagaagccgggtgccccacttctgcccccacctccccagaacagcgtcccccattatgccgaggctgacattgtcaccctgcagggcgtcacagggggcaacacctatgctgtgcccgcgctgcccccaggggctgccggggatgggcctcccagagtggatttccctcgatctcggctccgcttcaaggagaagcttggcgagggccagtttggggaggtgcacctgtgtgaggtagagaacccgcaagatctggtcagtcttgattttccccttaatgtgtgcaagggacaccctttactggtagctgtcaagatcctacggccagatgccaccaagaatgccaggaatgatttcctgaaggaggtgaagatcatgtcaaggctgaaggacccaaacatcatccggctcctgggcgtgtgtgtgcaggatgaccccctctgcatgattactgattatatggagaatggtgaccttaaccagttcctcagtgcccaccagctagaagacaaggcggctgagggggcccccagggacagggaggctgcccaggggcccaccatcagctaccccatgctgctacatgtggcggctcagattgcctcaggcatgcgctatctggccacactcaactttgtgcatcgggacctggccacaaggaactgcctggttggggaaaatttcaccatcaaaattgctgattttggcatgagccggaacctctacgctggggactattaccgcgtgcaaggccgggcggtgctgcccatccggtggatggcctgggagtgcatcctcatggggaagttcacaactgcaagtgacgtgtgggcctttggggtgaccctgtgggaggtgctgatgctctgccgtgcccagccctttggacagctcactgacgagcaagtcattgagaatgcaggggagttcttccgggaccagggccgtcaggtgtacctgtctcggcccccttcctgcccgctgggcctgtatgagctgatgctccgctgctggagccgggagcctgagcagcgaccatccttttcccagctacatcggttcctggcggaagatgcgctcaacacggtgtgaatcacacccagctgccccttcctcagggagaattaaggcaaaaccagaggcgataagcaagggaattgaatggtacccccactctgttctctgtcctgaccacccttcacctctaagagagaggcagggtgaccagaggtgggctgggcctgccagggagctgatgccttcccttcccgggacatactctcatgccccctccctgctcctctcttggaagcctctgctgcccacccagctggccctgtggatgggatcctctctgacctcttctagccatccctggggaggggggagatgggggcacatataggacagacactggataaggcctattggagcacctgggccccattggacaacactggttcctagagagaaggctgtggctcacctagcctctctctttccatcgcacactggatcccattggctgagaatctgaggaatgaggacaagaaagggagaaacatgttcccttgtgctaactcctggaattgtccttgtctttggcttctccctccaacatcctctaaaacactggacctaggggtgatccctgtcccctacccctagccatccccacttcccacctgctgtgttgtagctagaacttctctaagcctgtatgtttctgtggattaaatactggggttagggggaaagagggagcaatggcctgcagccttggggttggacatctctgttgtagctgccatattggtttttctatactcacttggggtttgtacatttttggggggagagacacagatttttacactaatatatggttctagctcaatgcaattttaatatcctgcactaggcaggtaataataaaggttgaattttc

SEQ ID NO: 116 - DNA, 3770 bp, Bos taurus
  modified_base (3698)..(3698): a, c, t, g, unknown or other
ggaggccccgcttcggggtcggacgcccgggtctgcggcgaagagcgatgagagagatgctgcccccgcccccataggcccaagggatctggagcaatgggaccaggggccctttcatttctactgctgctgctcttggtggcaactggagatgctgacatgaagggacattttgaccctgccaagtgccgctatgccctgggcatgcaggaccggaccatcccagatggtgacatctctgcctccagctcctggtcagactccaccgccgctcgccacagcaggcttgaaagcagcgacggagatggcgcctggtgccctgcagggccggtgttccccaaggaggaggaatacctccaggtggacctgcggcggctgcacctggtggcactggtaggcacccagggacggcacgcagggggcctgggcaaggagttctctcccagctaccgactgcgttactcccgggacggccaccgctggatggactggagggaccgctggggccaggaggtgatcttaggtaatgaggatcctgggggagtggtgctgaaggaccttgggccccccatggtggcccgactggttcgcttctatccccgggcagaccgggtcatgagcgtgtgtctgcgggtggagctctatggctgcctctggaaggatggactcctgtcttacacggcccctgtggggcagacgatgtacttatctgaggccgtgcacctcaatgactccacctacgatggatataccacgcacactgttgccaggctgcagtacggagggctgggccaactggcagatggtgtggtggggctggatgactttaggaagagccaggagctacgggtctggccgggctacgactatgtgggctggagcaaccacagcttccccagtggctacgtggagatggagtttgagtttgagcggctgagggccttccaggccatgcaggtccactgcaacaacatgcacacgctgggagcccgcctgcctggtggggtggagtgtcgcttcaagaggggcccggccatggcctgggagggggagcccgtgcgccatgctctggggggcagcctgggggaccccagagcccggactgtgtcagtgcccctgggcggccgcatgggccgcttcctgcaatgccgctttctctttgcggggccctggctactcttcagcgaaatctccttcatttccgatgttgtgaatgactcctccctggctttggggggcaccttcccaccagccccctggtggccacccggcccccctcccacaaacttcagcagcttggagctggagcccaggggccagcagcctgtggccaaggccgaggggagcccgaccgccatcctcattggctgcctggtggccatcatcctgctgctgctgctcatcattgccctcatgctatggcggctgcactggcgccggctcctcagcaaggccgagcgtagggtattagaagaggagctgacggttcatctctctgtccccggggataccatcctcatcaacaaccgcccaggcccccgagagccacccccttatcaggagccacggcctcgtgggaatccaccccactctgctcccagtgtccccaacagctcggcgttgctgctctccaatccggcctaccgtctccttctggccacttacgcccgcccccctcgaggcccgggcccccccacacccgcctgggccaaacccaccaacacccaggcctgcagtggggactatatggagcctgagaagccaggtgccccgcttctgcccccacctccccagaacagcgtcccccattatgccgaggctgacattgtcaccctgcagggcgtcaccgggggcaacacctatgctgtgcccgcgctgcccccaggggcggctggggatgggccccccagagtggatttccctcggtcgaggctccgcttcaaggagaagcttggcgagggccagtttggggaggtgcacctgtgtgaggtagagagccctcaggatctagtcagtcttgacttccccctcagtgtgcgcaagggacaccctttgttggtagcagtcaagatcctacggtcagatgccaccaagaatgccaggaatgacttcctgaaggaggtgaagatcatgtcgaggctgaaggacccaaacatcatccggctgctgggtgtgtgtgtgcaggacgacccgctctgcatgataaccgattacatggagaacggcgacctcaaccagttcctcagtgcccaccagctagaggacaaggcgacggaggggcccggggatggggaggcggcccaggggcccaccatcagctacccgatgctgctgcacgtggcggcccagatcgcctcgggcatgcgctatctggccacactcaactttgtgcatcgggacttggccacgaggaactgcctggttggggaaaatttcaccatcaaaatcgccgactttggcatgagccggaacctctacgctggggactattaccgcgtgcagggccgggcggtgctgcccatccggtggatggcctgggagtgcatccttatggggaagttcacaaccgccagtgacgtgtgggcctttggggtcaccttatgggaggtgctgatgctctgcagggcccagccctttggacagctcactgatgagcaagtcatcgagaatgcaggggagttcttccgggaccagggccggcaggtgtacctgtcccggcccccggcctgcccgctgagcctgtatgagctgatgctccggtgctggagccgggagcctgagcagcgaccacccttttcccagttgcatcggttcctggcagaagatgcggtcaacacagtgtgactcacaacacccagccgcccccatccgggggattcaggggaggctagtggcactaaacaagaggagcttacggcacccccactccattctccctcctgacctcccttcacctctgagaggcagtgtggctgaaggtgggctgggcctgccagggagctgatgccctcccttccccggacacgctctcatgcctccttcctgctcctctcctagaagcccctgccgcccacccagctggccctgtggatgggatcctctctgacctccttgagccatcccttggggaggctgggagaagatatagggcagacactggacctggcccactggcgcacctgggccccactggacaacactggtacctggagagaaggctgctgcccccagcctctctctttccgtcacacactggaccccactggctgagaatttgggaagtgaggaggacaagaaagggagaagggggttcccttgtatctcctcctggaattgccctcagctttggcctttccctcctccatcctctgaaacactggacttgggggtgatccctacccccacccttctgcctccccacctcccacctgccgtgttgtagctagaacttctccaagcctgtatgtttctgtggaataagtattgggattagcggggaaacagagagcaacggcctgtggccctggggttggacatctctatcgtagctgccacattggtttttctataatcacttggggtttgtacattttggggggggagagacacagatttttacactaatatatggatctagctcaatgctattttaatcccctgcactaggcaggtaataataaaggttgagttttccacanaaaaaaaaaaaaaaaaaaaaaaaaaaaaaaaaaaaaaaaaaaaaaaaaaaaaaaaaaaaaaaaaaaaaaaaa

SEQ ID NO: 117 - DNA, 3814 bp, Mus musculus
gctgtcccctccctctctgcgggggctgagaggctcagcgaggggagcagagctgggttgccatggtcaccttgaagccagccgcagctggccagggcagctgctcttgggcccccgaggctggagcttggacaaagccgggaggcttcatcggcctcagacctggatccccaaaggcgtgtgcctagggagactgaaactcaggagaacctggagagatgctgtcccctcctccatagaccagagggatccagagcgatggggacagggaccctctcatctctactgctgctgctactcttggtgacaattggagatgctgacatgaagggacattttgaccctgccaagtgccgctatgccctgggcatgcaggaccgcaccattcctgacagcgatatctctgtgtccagctcctggtcggactctaccgctgcccgccacagcaggctggaaagcagtgatggagatggggcttggtgccctgcagggcctgtgttccccaaagaagaggagtacttgcaggtggaccttcgtaggctacacctggtggctctggtgggcacccagggccgccatgctgggggtctgggcaaagagttctcccgaagctatcggttgcgttactcccgagatggccgccgctggatggactggaaggaccgctggggacaggaggtgatttcgggtaacgaggatcccgggggagtagtgctgaaggaccttgggccccccatggtggcccggctggtccgcttctaccccagggctgaccgggtcatgagtgtctgtcttcgggtggagctctatggctgcctctggcgggatggactcctgtcatatacagcccccgtggggcagaccatgcagttatctgaggtgatggtacatctcaatgattccacttacgatggatatactgctggagggctgcagtatggcggtctgggccagctggcagatggcgtggtgggcctggatgatttcaggcagagccaggagctgcgggtctggccaggctatgactatgtgggatggagcaatcagagcttccccacgggctacgtggagatggagtttgagtttgatcggttgaggaccttccagaccatgcaggtccactgtaacaacatgcacactctgggagcccgcctaccaggcggggtggaatgccggtttaaaaggggtcccgccatggcctgggaaggagagcctgtccgccatgctctgggaggcagccttggagaccccagagcccgggccatctcagtgcccctgggtggccacgtgggccgctttctgcagtgcagattcctctttgcaggtccttggttactcttcagtgagatctctttcatctcagatgtggtgaacgactcctctgacaccttcccaccagccccctggtggccacctggcccgcctcccaccaacttcagcagcttggagctggagccccggggtcaacagccagtggccaaggcggaggggagcccaactgccatcctcattggctgcctggtggccatcatcctgctgctgcttctcatcatcgcgctgatgctctggaggctgcactggcgccggctgctcagcaaggctgagcgccgcgtgttggaggaggagctgacggttcacctttctgtccctggggacaccatcctcatcaacaaccgcccaggaccccgagagccacccccttaccaggagccccggcctcgggggactccaccccattctgcaccctgcgtccccaacggctctgcgttgctgctctccaatccggcctaccgcctccttctggccacttacgcccgtccccctcgaggcccgggcccccccacacccgcctgggccaaacccaccaacacccaggcctgcagtggggactatatggagcccgagaagccgggtgccccgcttctacccccacctccccagaacagcgtcccccattatgccgaagctgacattgtcaccctgcagggcgtcactgggggcaacacctacgctgtgcctgcactgcccccaggggcggttggggatgggccccccagagtggatttccctcggtcacggctccgcttcaaggagaagcttggcgagggccaatttggggaggtacacctgtgtgaagtagaggacccgcaagatctggtcagtagtgacttccctatcagtgtgcacaagggacaccccttgctggtagcagtgaagatcctccggccagatgccaccaaaaatgccaggaatgatttcctgaaggaggtaaagatcatgtcacggctgaaggacccaaacatcatccggctcctgggtgtgtgtgtgcaggatgaccccctctgcatgatcacagactacatggagaacggcgatctgaaccagttcctcagtgcccgccagctggagaacaaggccactcaggggctctctggggacacagagtctgaccaggggcccacaatcagctaccctatgctgttacacgtgggggcccagatcgcctctggcatgcgttatctcgccacgctgaactttgtgcatcgggacctggccacccggaactgcttggttggggaaaatttcaccatcaaaatcgccgactttggcatgagccggaatctctacgctggggattattaccgtgtccagggccgggcggtgctgcccatcaggtggatggcttgggagtgcattctcatggggaagttcacaacagccagtgacgtttgggccttcggagtgaccctgtgggaggtgctgatgctctgcaggtcccagccctttgggcagcttacagatgagcaggttatcgagaatgccggcgagttcttcagggaccagggccggcaggtctacttgtccaggccacccgcctgcccacagaccctgtatgagctgatgctccggtgttggagccgggagcccgagcagcggccgcccttcgcccagcttcatcggttcctggcggatgatgcgctcaacacggtgtaaactcaggacccggcagccctttcccaatgggagccatccaggggaagctggactcgaaaaccagagaagcctatggcaccgcaccccaccgtctccatacttgcccattcccaagaggcagtgtctctgcgggtgggctgggcctgcccgaggagcagatacacacactcccttccgtttcttccttccatctgccaagtgccaccctcccagctggccctgtggttgggatcctgcctgacttcttccagctatccccttggggaagaacgggggcaaatgctgggcgtacactggacaaggcccactggacaacactggttcctgggaggtgacggtgccccccagctttcttcttgtcacacactggacgccgccagctgagaattagaggggtgagggggacaaggacggccaacccctacagcggtcctcagccctggcttccttctgttccgccccctgacacactggacctgggggcgatccctgccgttgatcctcagtcacacacccctccttctcacctgccatgctgcagctagaacttcgcaaagcctctatgtttctgtggagtaaatattaggatggggaacagagggagcaatagcttgaggctgggggtggggatttctattgtagctaccacattggtttttctataatcacgcggggtttgtacattttttggggggagagaaacacagatttttacactaatatatggacctagcttaaggcgattttaatcccctgtcctaggcaggtaataataaaagttgagttgttttttgttttttgtttttccacaaaaaaaaaa

SEQ ID NO: 118 - DNA, 3703 bp, Mus musculus
gctgtcccctccctctctgcgggggctgagaggctcagcgaggggagcagagctgggttgccatggtcaccttgaagccagccgcagctggccagggcagctgctcttgggcccccgaggctggagcttggacaaagccgggaggcttcatcggcctcagacctggatccccaaaggcgtgtgcctagggagactgaaactcaggagaacctggagagatgctgtcccctcctccatagaccagagggatccagagcgatggggacagggaccctctcatctctactgctgctgctactcttggtgacaattggagatgctgacatgaagggacattttgaccctgccaagtgccgctatgccctgggcatgcaggaccgcaccattcctgacagcgatatctctgtgtccagctcctggtcggactctaccgctgcccgccacagcaggctggaaagcagtgatggagatggggcttggtgccctgcagggcctgtgttccccaaagaagaggagtacttgcaggtggaccttcgtaggctacacctggtggctctggtgggcacccagggccgccatgctgggggtctgggcaaagagttctcccgaagctatcggttgcgttactcccgagatggccgccgctggatggactggaaggaccgctggggacaggaggtgatttcgggtaacgaggatcccgggggagtagtgctgaaggaccttgggccccccatggtggcccggctggtccgcttctaccccagggctgaccgggtcatgagtgtctgtcttcgggtggagctctatggctgcctctggcgggatggactcctgtcatatacagcccccgtggggcagaccatgcagttatctgaggtgatggtacatctcaatgattccacttacgatggatatactgctggagggctgcagtatggcggtctgggccagctggcagatggcgtggtgggcctggatgatttcaggcagagccaggagctgcgggtctggccaggctatgactatgtgggatggagcaatcagagcttccccacgggctacgtggagatggagtttgagtttgatcggttgaggaccttccagaccatgcaggtccactgtaacaacatgcacactctgggagcccgcctaccaggcggggtggaatgccggtttaaaaggggtcccgccatggcctgggaaggagagcctgtccgccatgctctgggaggcagccttggagaccccagagcccgggccatctcagtgcccctgggtggccacgtgggccgctttctgcagtgcagattcctctttgcaggtccttggttactcttcagtgagatctctttcatctcagatgtggtgaacgactcctctgacaccttcccaccagccccctggtggccacctggcccgcctcccaccaacttcagcagcttggagctggagccccggggtcaacagccagtggccaaggcggaggggagcccaactgccatcctcattggctgcctggtggccatcatcctgctgctgcttctcatcatcgcgctgatgctctggaggctgcactggcgccggctgctcagcaaggctgagcgccgcgtgttggaggaggagctgacggttcacctttctgtccctggggacaccatcctcatcaacaaccgcccaggaccccgagagccacccccttaccaggagccccggcctcgggggactccaccccattctgcaccctgcgtccccaacggctctgcctgcagtggggactatatggagcccgagaagccgggtgccccgcttctacccccacctccccagaacagcgtcccccattatgccgaagctgacattgtcaccctgcagggcgtcactgggggcaacacctacgctgtgcctgcactgcccccaggggcggttggggatgggccccccagagtggatttccctcggtcacggctccgcttcaaggagaagcttggcgagggccaatttggggaggtacacctgtgtgaagtagaggacccgcaagatctggtcagtagtgacttccctatcagtgtgcacaagggacaccccttgctggtagcagtgaagatcctccggccagatgccaccaaaaatgccaggaatgatttcctgaaggaggtaaagatcatgtcacggctgaaggacccaaacatcatccggctcctgggtgtgtgtgtgcaggatgaccccctctgcatgatcacagactacatggagaacggcgatctgaaccagttcctcagtgcccgccagctggagaacaaggccactcaggggctctctggggacacagagtctgaccaggggcccacaatcagctaccctatgctgttacacgtgggggcccagatcgcctctggcatgcgttatctcgccacgctgaactttgtgcatcgggacctggccacccggaactgcttggttggggaaaatttcaccatcaaaatcgccgactttggcatgagccggaatctctacgctggggattattaccgtgtccagggccgggcggtgctgcccatcaggtggatggcttgggagtgcattctcatggggaagttcacaacagccagtgacgtttgggccttcggagtgaccctgtgggaggtgctgatgctctgcaggtcccagccctttgggcagcttacagatgagcaggttatcgagaatgccggcgagttcttcagggaccagggccggcaggtctacttgtccaggccacccgcctgcccacagaccctgtatgagctgatgctccggtgttggagccgggagcccgagcagcggccgcccttcgcccagcttcatcggttcctggcggatgatgcgctcaacacggtgtaaactcaggacccggcagccctttcccaatgggagccatccaggggaagctggactcgaaaaccagagaagcctatggcaccgcaccccaccgtctccatacttgcccattcccaagaggcagtgtctctgcgggtgggctgggcctgcccgaggagcagatacacacactcccttccgtttcttccttccatctgccaagtgccaccctcccagctggccctgtggttgggatcctgcctgacttcttccagctatccccttggggaagaacgggggcaaatgctgggcgtacactggacaaggcccactggacaacactggttcctgggaggtgacggtgccccccagctttcttcttgtcacacactggacgccgccagctgagaattagaggggtgagggggacaaggacggccaacccctacagcggtcctcagccctggcttccttctgttccgccccctgacacactggacctgggggcgatccctgccgttgatcctcagtcacacacccctccttctcacctgccatgctgcagctagaacttcgcaaagcctctatgtttctgtggagtaaatattaggatggggaacagagggagcaatagcttgaggctgggggtggggatttctattgtagctaccacattggtttttctataatcacgcggggtttgtacattttttggggggagagaaacacagatttttacactaatatatggacctagcttaaggcgattttaatcccctgtcctaggcaggtaataataaaagttgagttgttttttgttttttgtttttccacaaaaaaaaaa

SEQ ID NO: 119 - DNA, 2733 bp, Rattus norvegicus
atggggacagggaccctctcatctctcctgctgctgctactcttggtgacaattggagatgctgacatgaagggacattttgacccagccaagtgccgctatgccctgggcatgcaggaccgcaccattccagacagcgatatctctgtgtccagctcctggtcggactctaccgccgcccgccacagcaggctggaaagcagtgatggagatggggcttggtgccctgcagggcctgtgttccccaaagaagaggagtacctgcaggtggaccttcgtaggctacacctggtggctctggtgggcacccagggccgccatgctgggggtctgggcaaagagttctcccgaagctaccggttgcgttactcccgagatggccgacgatggatggactggaaagacagatggggtcaggaggtgatttcgggtaacgaggatcctgggggagtggtgctgaaggatctcgggccccccatggtggcccggctggtccgtttctaccccagggctgaccgggtcatgagtgtctgtcttcgggtggagctctatggctgcctctggcgggacggactcttgtcctatacagcccccgtggggcagaccatgcaattatctgagatggtgtatctcaatgattccacttacgatggatatactgctggagggctgcagtacggtggtctgggccaactggcagacggcgtggtggggctggatgatttcaggcagagccaggagctgcgggtttggccaggctatgactatgtgggatggagcaaccatagcttccccagcggctacgtggagatggagtttgagtttgatcggctgaggtctttccagaccatgcaggtccactgtaacaacatgcacactctgggagcccgcctcccaggcggggtggaatgccggtttaaaaggggtccggccatggcctgggaaggagagcctgtacaccatgccctggggggtagccttggagaccccagagccagggccatctcggtgcccctgggtggtcacgtgggccgcttcctgcagtgcagattcctctttgcaggaccctggttactcttcagtgagatctctttcatctcggatgtggtgaacgactcgtctgacaccttcccaccagccccctggtggccgcctggcccgcctcccaccaacttcagcagcttggagctggagccccggggtcaacagcctgtggccaaggcggaggggagcccaactgccatcctcattggctgcctggtggccatcatccttctcctcctccttatcattgccctgatgctctggaggctgcactggcgccggctgctcagcaaggcagagcgccgggtgttggaggaggagctgacggttcacctctctgtccctggggacaccatcctcatcaacaaccgcccagggccccgagagccacccccttaccaggaaccccggcctcgggggactccaactcactctgcgccctgcgtccccaatggctctgcgttgctgctctccaatccggcctaccgcctccttctggccacttacgcccgtccccctcgaggcccgggcccccccacacccgcctgggccaaacccaccaacacccaggcctgcagtggggactacatggagcccgagaagccgggcgccccacttctacccccacctccccagaacagcgtcccccattacgccgaggctgacattgtcaccctgcagggcgtcacagggggcaacacctacgctgttcccgcactgcccccaggggcggttggggatgggccccccagagtggatttccctcggtcacggctccgtttcaaggagaagctcggcgagggccaatttggggaggtacatctctgtgaagtagaggaccctcaagatctggtcactagtgacttccctatcagtgtgcaaaagggacaccccttgctggtggcagtgaagatcctccggccagatgccaccaaaaatgccaggaatgacttcctgaaggaggtaaagatcatgtcacggctgaaggacctaaacatcatcaggctcctgggtgtgtgtgtgcaggatgaccctctctgcatgattacagactacatggagaacggtgacctgaaccaattcctcagtgcccaccagctggagaacaaggtcactcaggggcttcctggggacagagagtctgaccaggggcccacaatcagctaccctatgctgttacacgtgggggcccagattgcctctggcatgcgatatctggccacccttaactttgtgcatcgggacctggccacccggaactgcttggttggggaaaatttcaccatcaaaatcgccgactttggcatgagccggaatctctacgctggggattattaccgtgtacagggccgggcagtgctgcccatcaggtggatggcctgggagtgtatcctcatggggaagttcacaacagccagtgatgtgtgggccttcggagtgaccctgtgggaggtgcttatgctctgcaggtcacagcccttcgggcaactcacagacgagcaggtcatcgagaacgccggcgagttcttcagggaccagggccggcaggtatacttatccaggccacccgcctgcccgcagaccttgtatgagctgatgctccggtgttggagccgggagccggagcagcggccgcccttctcccagcttcatcggttcctggcggatgatgcactcaacacagtgtaa

SEQ ID NO: 120 - DNA, 4304 bp, Homo sapiens
cttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatcatttttttttttttttttgaaagtgtgttagcatcttgttactcaaaggataagacagacaataatacttcactgaatattaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaaaaaaaaaaaaaaa

SEQ ID NO: 121 - DNA, 4289 bp, Pan troglodytes
cacttgggcgttggaccccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgccgctgctgctgctcgcccagtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaagatgagccggccgccgccgccgcccccgaggccggggccagcccggtagagaaggaggcccccgcggaaagcgaggctgccgagcccggctcgcccacggccgcggagggagaggccgcgtcggccgcctcctcgacgtcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggtccggcgcgcccccggagcaggaggcagcccccgcggaggagcccgcggccgccgcagcctcgtcagcctgcgcagccccttcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttttttttctcccctccccacagatcccatctcaaatcattctgttaaccaccattccaaccggtcgaggagagcttaaacaccttcttcctctgccttgtttctcttttattttttattttttcgcatcagtattaatgtttttgcatactttgcatctttattcaaaaatgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtcttttttttttttttaaagaaaagttattaccatgtattttgtgaggcaggtttacaacactacaagtcttgactaagaaggaaagaggaaaaaagaaaaaacaccaatacccagattaaaaaaaaaaaaaagatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgttttttatgttctaataattctgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacattccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaattgagtgagagtctatagaatccatactgcagatgggtcatgaaatgtgaccaaatgtgtttaaaaattgttggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatccttttttttttttttttttttgaaagtgtgttagcatcttgttactcaaaggataagatagacaataatacttcactgaatattaataatctttactagtttacctcctctgctctttgccacccgataactggatatctttttcttcaaaggaccctaaactgattgaaatttaagatatgtatcaaaaaccattatttcatttaatgcacatctgttttgctgtttttgagcagtgtgcagtttagggttcatgataaatcattgaaccacatgtgtaacaactgaatgccaaatcttaaactcattagaaaaataacaaattagcttttgacacgcattcttaattggaataatggatcaaaaatagtggttcatgaccttaccaaacacccttgctactaataaaatcaaataacacttagaagggtgtgtatttttagtcagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaggactcagtaaaaaagtggatttttaaaaataactcccaaagtgaatagtcaaaaatcctgtgtagcaaactgttatatattgctaagtttgttcttttaacagctggaatttattaagatgcattattttgattttattcactgcctaaaacactttgggtggtattgatggagttggtggattttcctccagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataatcaagcctgc

SEQ ID NO: 122 - DNA, 2893 bp, Canis lupus
ttctccattttcctcttgtctacggtgcggctacaaatctgggattttttttttttattacttctttttttttttttttttaaagaaaggctacacttgggctccttttttcgtgctcgactcttttcctccccctttttttttttttttttttttccctccctcctgcgctgctgcttttttagctctcggacttcaggtttttttacccggagtgtatttagtcggttctgtcctgtcctctccgccacccccactcccccctccctccctccggggtgtgtgccgctgccgccgccgctgccgccgccgctcgccccgtcgttgcaccaaccggaggctctttgtttcccccccttggatctgttgagtttctttgttgaagaagccagcatgggtgcccagttctccaagaccgccgccaagggagaggccgccgccgagaggcccggggacgcggccgtggcctcgtcgccctccaaagcgaacggccaggagaacggccacgtgaaggtgaacggggacgcgtcccccgcggccgccgagccgggcgccaaggaggagctgcaggccaacggcagcgccccggccgccgacaaggaggagcccgcggccgcggggagcggggcgccggccgccgagcaggaggagccgcccgccgaccgcgaggccgcccccgcccccgcccccgccgccgccgcccccgccgcgcccgccgcgcccgccgacagggagcccgaggccgaggccgccgagccggggtcgccggggtcgccggcggccgccgagggggaggccgcgtccgccgcgtcgtccacgtcgtcgcccaaggcggaggatggcgccgcgccctcgcccagcggggagaccccgaaaaaaaaaaagaagcgcttctccttcaagaagtccttcaagctgagcggcttctccttcaagaagaacaagaaggaggcgggcgaggcggaggccgaggcggcggggggcgcgcccgcagacggccgcaaggacgaggccgccgagccgggcgcgcaggcgcaggcgcagccgcaggcgcaggcggccgaggccgcggaggccgcgggggaggccgcggaggccgccgagccccgggcggctgagcaggcggcggccggcggcccgcaggaggcccagccccgcgacgccgccccgcccgagcagccgcccgccgccgcggggcccggggaggccgccgagcccggggaggccgcgggggaggccgcgggggaggccgcggaggcgccggccgcgggccccgagcaggaggcggcggcggcctcggcctcggccgcggaggaggcggcggcgggctcggcctcggcctcggcctcggcctcggccacggcggccgcgtcctcgcaggagccccagcccgagtgcagtccggaaggccccccggcggaggcggccgagtagaggcgcggagcgccgagccgacccgagaactcttctcccccgcccccaccccccgttcgtttgttggagtggtgccaggtactggttttggagaactcgtctacaaccagggattgatttttaaagatgtctttttttttttttttttttgattttaccttttttttttttttaatgcagcaaattttgttcccccctcctccctccccccccccacagatcccatctcagatcattctgttaccaccattccaacaggttgaggagcgcttaagccaccttcctccgccttgtgtgtctctttcgttttttttttttattttttattggtttttttttttttgcaacagtattaaagttttttgcatactttgcatctttattcaaaaatgtaaactttctttgtcaatctatggacatgcccctatatgaaggagatgggtgggtcaaaagggatatcagatgaagtgataggggccacgaaggggaaatctccagtggggcgtgacattgccaagaacaatgtaccactagaagcgatggtgtaaaggcttagtctttttttttttttttttaaagaaaagttattacaatgtattttgtgaggcaggtttacaacactacaagtcttggctaaaaaggaaaggaaaaagaaaaaaaaaaaacaccaatacccagatttaaaaaaaaaaaaaagatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactctccaccctgcccatttttgtaaaactgcagtcatcttggaccttttaaacacaaattttaaactcaaccaagctgtgataagtggaatggttactgtttatactgtggtatgtttttgattacagcagacaatgctttcttttccagtcgtctttgagaataaaggaaaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatctgttgtgtttatttatgttctgataaagtaccgagacctctaggtctcaaggatagttttgaggaacatctcgcatgccatcaagagtaaattttcttgtggtttgtaatctgaagttttccagactctgaaattcataatcagcagtgtcagattacacgc

SEQ ID NO: 123 - DNA, 1008 bp, Bos taurus
atgggtgcccagttctccaagaccgccgcgaagggagaagccaccgcggagaggcccggggaggcggctgtggcctcgtcgccttctaaagcgaatgggcaggaaaatggccacgtgaaggtaaacggcgatgcttctcccgcggccgccgagcccggcgccaaggaggagctgcaggccaacggcagcgccccggcggccgacaaggaggagcccgcggccgccgggagtggggcagcgtcgcctgccgcggccgagaaagatgagccggccgccgctgcccccgacgccggccaccccgtggagaaggaggcccccgtggagggcggagccgcggagcccggctcacccacggccgccgagggggaggccgcctctgccgcctcctcgagctcttcgccgaaggctgaggacgggggccacgccctcgcccagcaacgagacgccgaaaaaaaaaaaaagaagcgcttttccttcaagaagtctttcaagctgagcggcttctccttcaagaagaacaagaaggaggcaggagagggcggtgaggccgaaggggccgccggcgcctccgccgaaggcggcaaggacgaggcctctgggggcgccgctgcggccgccggcgaggcgggtgcggcccccggggagccgacagcggcgccaggcgaggaggcggccgcgggcgaggagggggcggcggggggcgacccgcaggaggccaagcccgaggaggctgccgtcgcgcccgagaagccgcccgccaggcgaggagctaaggccgtcgaggagcccagcaaggctgaagagaaggcagaagaggccggggtcagcgcggccggcgcggccggctgcgaggcgccctcggccgccgggccgggctgccccagagcaggaggcgccccccgtgaggaggcagcgccgccccgggcgtcgtcagcctgctcagccccctcacaggaggcccagcccgagtgcagtccagaagcgcccccagcggaggcagccgagtaa

SEQ ID NO: 124 - DNA, 4186 bp, Mus musculus
gcacttgggcgttggaccccgcatcttattagcaaccagggagatttctccattttcctcttgtctacagtgcggctacaaatctgggatttttttttattacttctttttttaaaaaaactacacttgggctccttttttgtgctcgacttttccacctttttccctccttcctgcgctgctgcttttttgatctcttcgactaaaaattttttatccggagtatttaatcgggtctcttctgtcctcctcgccacccccaccccctccctccggtgtgtgtgccgccgccgctgttgctgctgctgctgctcgccccgtcgttacaccaaccgaaggctctttgtttcctctcttggatctgttgagtttctttgttgaagaagccagcatgggtgcccagttctccaagaccgcagcgaagggagaagccaccgccgagaggcccggggaggcggctgtggcctcgtcgccttccaaagcaaatgggcaggagaatggccacgtaaaagtgaacggggacgcgtctcccgccgccgccgagccgggcgccaaggaggagctgcaagccaacggcagcgccccggccgccgacaaggaggagcccgcgagcggcagtgccgcgacccccgccgcggccgaaaaggatgaggctgccgcggccaccgagccgggcgccggcgcggccgacaaggaggctgcggaggccgagcccgccgagcccagctccccggccgccgaggccgagggcgcgtccgcctcctccacgtcgtcgcccaaggcggaggacggggccgcgccgtcgcccagcagcgagaccccgaaaaaaaaaaagaagcgcttttccttcaagaagtccttcaagctgagcggcttctccttcaagaagagcaagaaggagtcgggcgagggcgctgaagcagagggagcgaccgcggaaggcgccaaggacgaggctgcagccgcagcgggcggcgagggggccgcggcccccggggagcaggcaggcggggcgggcgccgagggcgcggcgggcggagagccccgggaggccgaggcggcggagcccgagcagccggagcagccggagcagcccgcggcggaggagccgcaggcggaggagcagtcggaggcggcgggggagaaggcggaggagcccgcgcccggcgccaccgcgggcgatgcgtcctccgccgcagggcctgagcaggaggcgcccgctgccaccgacgaggccgcggcgtccgcagcccccgccgcgtcgccggagccgcagcccgagtgcagtccggaggcgccccccgcgccaacggccgagtaagctccagagccctcacgcaattcaagaacttttccccccagtttgtttgttggagtggtgccaggtactggttttggagaacttgtctacaaccagggattgattttaaagatttttttttaaatttcacattttttttaagcagcaaattttttgttttttgttttttttaagcccccttccccacagatcccatctcagatagttgtttccaccattccgacaggccgaggacgtgttagacagcttcctctgccttctttctttacttttactttttttttttttttttggcatcagtattaatgttttttgcatactttgcatctttattaaaaaagtgtaaactttctttgtcagatctatagacatacccatatatgaaggagatgggtgggtcaaaaggaataacaaatgaagtgataggggccactatgggaaattgaagcagtgcataacattgccaagataatatgccactaaaatggtggtgggtgtaaaggcttagggttcttgtcctttctttctttctttctttctttctttctttctttctttctttttttttttaaagaaaaattattacgatgtattttgtgaggcaggtttacaacactacacgttttgaataagaaggaaagagaaaaaaataaaaacaccaatacccagatttaaaaaaaaaaaaaaagatcatagtcttaggagttcatgtaaaccataggaacttcctgcttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccttcagaagcacatgaagtttgcaagtctccaccctgcccatttttgtaaaactgcagtcatcttggaccttttaaacacaaaattttaaactcaaccaagctgtgatacgtggaatggttactgtttatactgtggtatgttttttgattacagcagacaatgctttcctttccagttgtctttgagaataaaggagaaacagatcttcagatgcaatggttttgtgtagcatctcgtctctcgtgttttgtaaatactggaggagctttgaccaatttgacatagagctggaatgtaacgttgcttacaagcattgctattcaactcctgcttaaggtgttctaattttctgtgagcacactaaaagcaaaaaaataaatgtgaataaaatgtacaaatttgttgtgtttttttatgttctgaggctgacttctaggtcttagattaattttttaggaaggccttgcatgccatcaaaagtacatttggctgtggtttttgataagaagttttcaagctcagaaattcataatcagtgtcaaattaagtatgtaggaagatcttatactgtgtcagttgttaccatttacctgcttttagttatagcatgcgagaataagtcctttaagacaaaagtggcttgaccctaagactttcaaatgtcttatgagactatttcataaactgtttccttgtcattgcaggtccagaaagttacattttataatcaggaagaatgtggagttcagactgcacataagtcatgaaaagatggccaaacctgtttaaatgttgatggtttatgtagtataagccttagcgtttggctcgtttccaaagtgttcttgaactgatatgctatacttcatggacaggtttctataaggaagtaatggtgttgaatggacttattgtcagtttgggccattagcatagctgcaagcttggttttgtttttgttttttagtcaaagtgttagcatcttttattcaaatgaaaagataatcctttatatattaactcttactagtttactttctgcttattttccatctcataactggatatttttactttactggaccctaaactgaattctttttattttttaccattgctttattaaatgcaaaatagtctacctgttgtgctcttttcttgagtagagtgcagggtggagttcagggtaaagttgaaccactctggtggcacctcaatattacatcgtattaaaaaaagagataacagcattagcctttcaataatgttcctctaattgaaataatagatcaaaattaatggatacttttctttctaaatatcctccctgataataaaaccaagtaacacttgaaagaataaacttgaccctgagtttcttgaggttttggaagattaaagtcaaacctggtaaccaaaggactgagtggtgggtcgttcccgctttaaccaacttgtttgagaacccctagttggccagatatggtgcctggtatgtagtaggacttaactgaaatgggttttaaaaaaataactcctgaactgagtagttaaaaatactgtgtagaaaagtattctatattgctaggtttgttcttttaacagctgagatttattaagatgcattattttgattttaatcactgcctaaaacactttgggtggtattgatggagcggtggattttcctccaagtggctaaatgcaatttgacatacttttcatccaaagttttgtacatcctgttgttttctaatggaaaaaaaaatgttaatatggcttttttgtactactaaaaatagctttgagattaaggaaaataaataactcttgtacagttgagaatcgtgttattaagtctgtattggcagtgtgtgcagtggcctttgctgtggttatgaacactctggattataagaatcatttggtccaattcctattgcttgtaaataaagttttaccagttgatat

SEQ ID NO: 125 - DNA, 5087 bp, Rattus norvegicus
cgtctcgttttaccacagagggaaattaattatgtcgtttcatacagcggtaacatgctagcgagtttcgatcttctgcaaatggtcctcactgtgttttttagaaaagtgatcgctaattggaatagccggagagacgcgatttgaagcgctccaaggaacatttttaaaatattttatttcacgcctctgggagaaaggaagaagcatggcttaggctgtttgctgcttttgcatttcccacatctggcctacagacctaattccaactggagatctcgctaggtgaaattcgatcttcgtggtttaaatacctttcagtgtgggacgatttaccaattgcagcagtttaaagaaagaaaaaaacaaacaaaacccccaaaatccttgcgcactgtgaaacccttatgaaacgcggagggaaaaaaaaagctgctagcacacaaatcctatccattgtctttaacactcgcgtacacacttatacacgtaaacacacagagaagatgggggaggggagagagtggctagagacagacgcggatatagaccagcaagagtcaatgcgagtcaagttaaggctttctccgcccccatccataagtaccccctcccgtgttaattaattccaaacaaagcaagccaatcaagaaatgcattattattttctggccgagggagacgagaagcacgtaatttttaattgatttatttatttggaggacattaattctcggtctgaggctgatttttcaaaccgtttgcaaagcgcggctccattgttcgcccggagcgcaggccccgcctcctgctttgtgtgcggcgcgcggattggccagcgcgcgcgggggccgcgtcagcgcccgcgagcccattcatctgtgcacttgggcgttggaccccgcatcttattagcaaccagggagatttctccattttcctcttgtctacagtgcggctacaaatctgggatttttttttattacttctttttttaaaaaactacacttgggctccttttttgtgctcgacttttccacctttttccctccttcctgcgctgctgctttttgatctcttcgactaaaaattttttatccggagtgtatttaatcgggtctcttctgtcctcctcgtcacccccaccccctccctccggtgtgtgtgccgccgccgctgttgctgctgccgccgctgctgctgctcgccccgtcgttacaccaacccaaggctctttgtttcctctcttggatctgttgagtttctttgttgaagaagccagcatgggtgcacagttctccaagaccgcagcgaagggagaagccgccgctgagaggcccggggaggcggctgtggcctcgtcgccttccaaagcaaatgggcaggagaatggccacgtaaaagtgaacggggacgcgtcgcccgccgccgccgagccgggcgccaaggaggagctgcaggccaacggcagcgccccggccgccgacaaggaggagcctgcgagcggcggcgccgcgacccccgccgcggccgataaggatgaggcagccgcggcccccgagtcgggcgccgccacggccgacaaggaggctgcggaggccgagcccgccgagcccggctccccctccgcggagaccgagggcgcgtctgcctcctccacgtcgtcccccaaggcggaggacggggccgcgccgtctcccagcagcgagaccccgaaaaaaaaaaagaagcgcttttccttcaagaagtccttcaagctgagcggcttctccttcaagaagagcaagaaggaggccggcgagggcgctgaggcggaaggcgcgaccgccgacggcgccaaggacgaggccgcagctgcagccggcggcgacgcggccgcggccccgggggagcaggcgggcggggcgggcgccgagggcgcggagggcggagagtcccgggaggccgaggcggcggagccggagcagccggagcagcctgagcagcccgcggcggaagagccaagggccgaggagccgtcggaggccgtgggggagaaggccgaggagcccgcgccgggcgccaccgcagatgacgcgccctccgctgcggggcccgagcaggaggcgcccgccgccaccgacgagcccgcggcgtccgcagctccctccgcgtcaccggagccgcagcccgagtgcagtccggaggcgccccccgcgccggtggccgagtaagctccgggcgccctcttgtaattcaagaacttttccccccaagtttgtttgttggagtggtgccaggtactggttttggagaacttgtctacaaccagggattgattttaaagattttttttttaattttacattttttttttaaagcagcaaattttgttttcttttaaagcccccttccccacagatcccatctcaaatcattgttaccaccattccgacaggccgaggacggtttagacagcttcctctgccttcttttgtttttgtttttgttttttttttctttacttttactcttttttttttgcatcagtattaatgttttttgcatactttgcatctttattaaaaaaatgtaaactttctttgtcaaatctatggacgtacccatatatgaaggagatgggtgggtcaaaaaggaatatcaaatgaagtgataggggccactatgggaaattgaaacagtgcataacattgccaagataatatgccactaaaaacgacggtgtaaaggcttaggggtttccttctttccttttttttttttttaaagaaagttattacgatgtattttgtgaggcaggtttacaacactacacgttttgaataagaaggaaaaagaaaagaattaaaaacaccaatacccagatttaaaaaaaaaaaatcatagtcttaggagttcatctaaaccataggaacttcctgcttatctcatgttagctgtaccagtcagtaattatgtagaactacaagttgtataggctttattgtttattgctggtttatgaccttaataaagtgtaattatgtattaccagcagggtgtttttaactgtgattattgtataaaaacaaatcttgatatccttcagaagcacatgaagtttgcaagtctccaccctgcccatctttttgtaaaactgcagtcatcttggaccttttaaacacaaattttaaacccaaccaagctgtgatacgtggaatggttactgtttatactgtggtatgtttttttttttcttttttctttttttttttttttttttgattacagcagacaatgctttcttttccagttgtctttgagaataaaggaaaaacaaatcttcagatgcagtggttttgcgtagcacctcgtctctcgtgttttgtaaatactggaggatctttgaccaatttgacatagagctggaatgtaacgttgcttacaaacattgctattcaactcctgcttaaggtgttctaattttctgtgagcacactaaaagcaaaaaataaatgtgaataaaatgtacaaatttgttgtgtttttttatgttctgaggctgacttctaggtcttaggttaacttttagggaggccttgcatgccatcaaaagtacatttggctgtggtttttgataagaagttttcaagctctggaattcataatcagtgtcaaattacatatgtgggaagatcttatactgtgtcgattgttatcatttatctgcttttaatttgcatttaaaactgaaaattacttttactgtagttatgtagcatgccaaattaagccacttaagacagaagtggctggaccctaagactatttcataaactgttttcttgtcattgcaggtccagaagcaagagtgttgagttcagactgcacataagtcatgaaaagatggccaaacatgtttaaatgttgatggtttatatggtataagccttagcgtttggctcacttccaaattattgtcgaaatgtgctatactttacggacaggtttccataaggaagtaatggtgttcaatggacatattgttagttttggaccattagcatagcttcgaccttttttttttttcttttgaatcaaagtgttagcatcttgttactcaaatgaaaagataatcctttatatattaatccttactagtttactttctgcttattttccagcttataactggattttttttactggaccctaaactgattctttttttaactattgctttattaaatgcaaaatagtccacctgttgtgatttgagcagagtgccgggtggagttcagggtaaagttgagccacatctgtggtggcctctcaatattccatcatattaagaataacagcattagcttttggataatgctccctaattgaaataatggatcagaactaatggttcctttcctttctaaacagtctccctgctaatgataccaagtaacatttgaaagagtaaacttgatcctgagtttcttgagttcttggaagattaaagtcaaacctggtaaccaaaggactgatttgtgggtctttcccactttaaccaacttgttcgaaaacccctagttggccaaatatggtgcctggtatgtagtagcactcaactgaaatgggtttttaaaaaagaaaaaaaaaataactcctgaactgagtagttaaaaatactgtgtagaaaagtattctatattgctaggtttgttcttttaacagctgagatttattaagatgcattattttgattttaatcactgcctaaaaacactttgggtggtactgatggagtggtggattttcctccaaatggctaaatgcaatttgacatacttttcatccaaagttttgtacatcctgttgttttctaatggaaaaaaaatgttaatatggcttttttgtactactaaaaatagctttgagattaaggaaaataaataactcttgtacagttcagaatcgtgttattaagtctgtattggcagtgtgtacagtgacatttgctgtggttatgaacacttatctggattataaaaagcatttggtccaattcctatttcttgtaaaataaagttttaccagttgatataatcgagcct

SEQ ID NO: 126 - DNA, 1897 bp, Homo sapiens
acttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaaca

SEQ ID NO: 127 - DNA, 1938 bp, Pan troglodytes
gtcgctgcggaaggcgccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgccccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtacactgtgcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtctactttaaagtaaacattaaagattcttgtgatacaatcatttttggaaaagtgtactttatcattttaacaaagcattatggttgggaatgagacaattctctattttacagtgtatacagatataactatttcccctaatagggtgggaaaaatcgctactcgtgattactcctaaatttgtgaagtttatagttttattgtcttcaaatgtaactcatgtttatttcaaaaacattcacaaatatagaaaagtatacaaaacaaaacagtaagattgtctataatcgcatcatatgggaataaaaaacaaaaataa

SEQ ID NO: 128 - DNA, 1374 bp, Canis lupus
gcgcaggctcgaggagctcttggacgcggaggccgtgccctagtcagacggcgcagacatgtccgaacaaagtaaggatgtgtgtgacctcgtctctgcagccgaggcctccaattccgaggcgcaccgcagtcctgggggtcccggggagccctccccgtccgcgtctcaggccgccaccctcgcagggccggagaggcgtccttcaggcccgaccgacggctctctggcctcgcctccaccccaggcgtccagcgaagagggagacccaaaggccctgcagcaggccacggaggaaggccgcgcccaccaggccccgaccgcggcccagcctgcccctgcgccgccagccccggcccaactggtgcagaaggcgcacgagctcatgtggtacgtgttggtcaaggaccagaagagaatgatcatatggttcccagacatggtgaaggatgtcatcggcagttacaagaaatggtgcagaagcatcctcaggcgcaccagtctcatcctcgcacgagtgttcgggctgcacctgaggctcactagcctgcacacgatggagttttcgctcgttaaagcgcttgagccagaggagctggacagagtggcgctgagcaaccgcatgcccatgacaggcctcctgctgatgatcctgagcctcatctacgtgaagggtcgcggcgccagagagagcgccgtctggaacgtgctgcgcatcctggggctgcggccctggaagaagcactccacctttggagacgtgaggaagctcatcaccgaggagttcgtccgacagaattacctgaagtaccagcgcgtgccccacgtagagccacctgagtatgagttcttctggggctcccgtgccagccgcgaaatcaccaagatgcaaatcatggagttcctggccagagtctttaagaaagacccccaggcctggccttcccgatacagagaagctctggaggaggccagagctctgcgggaggctgatcccactgcctactgcccccgcagcagtgtctccgaggactagcaaggtctggaggcagatattaatggtttctgaccctcaccagggcggtggaggggtgggggtgggacattactagagtattcaggatttacagtgcagtatttcacgtgtaactttaagttttcagtactgtgcttttataccttttaatgcaatgttgtattcatttcagtactcctagatagtgtgtagaatttatgcatgtttgtttatgagtaagctcggttggtgctttcgcttttgtgctacctttgaattttttgtaccagagacgtgctaaacttatgaaattcattgagaaattttccatcttattcttttatatggaacagatgatg

SEQ ID NO: 129 - DNA, 1610 bp, Bos taurus
tcgcggagggaaagcagactcgaagagctcttggactcggcggccctgctcttgcgagaccgaacagatatgtccgaacaaagtaaggatgtgtgcaaccccaactttgcagccgaggcctccaactctgaggtgcacagcagccccggcattcccggggagccctcttctccagggtctcaggccgcgaccctcactgagtcggagagccctcccttaagcccgcctgatgcccctctggtctcgctgcctccccaggctccaggcgaagagggagacccgaaggccctgcagcaggccgctgaggaaggccgtccccaccaggccccgagcacaactcagctcagcccggcgcccccggccccggcccagctggtgcagaaggcacacgagctcatgtggtacgtgctggtcaaggaccagaagaggatgatcatctggtttccagacatggtgaaggatgtcatcggcagttacaagaagtggtgcagaagcatccttcggcgcaccagcctcatcctcgcacgcgtgttcgggctgcacctgaggctgaccagcctgcacaccatggagttttcgctggtcaaagctctggagccagaggagttggacagggtcgctctgagcaaccgcatgccgatgacaggcctcctgctgatgatcctgagcctcatttacgtgaagggtcgcggcgctcgagagagtgcagtctggaacgtgctgcgcatcttggggctgaggccttggaagaaacactccaccttcggagacgtgagaaagcttatcaccgaggagttcgtccagcagaactacctgaagtaccagcgcgtcccccatgtcgagccccctgagtacgagttcttctggggctcccgtgccagccgcgaaatcaccaagatgcagatcatggagttcctggccagggtctttaagaaaaccccccaggcctggccttcccgctacagggaggctttggaagaggctagagccctgcgggcggcccaccccactgcccactgcccccgcaacagtgtctcagaggactagcaaggtctggaggcaaatggaagttttctgcccctcaccagggtggaggaggggtgggagtgtgggacattagagtattcaggatctacagtgcagtatttcacgtgtaacttttaagttttccgtacagtgcttttatacctcttaatgcaatgttgtgttcatttcagtaatattagtgtgtaggattcatgcatggttgtttgtaagtaagctcagttggtgctttcgcttttgtgctacctttcttgaattttttgtaccagagatgtgctaaacttatgaaatacactgagacattttccatattcttttacgtgtgacagaggctgtgtattggggtagattggtcttggagagtttggaaaaactccccagaaaagctggcctaagcaagagaaaagttgacccctgtctttgtgctctgcctgggtacaagaaacatccctgtggagtttggtaatgtggactgaaacagactcaatgtgggcacactttactaaacacagatacaacctcaccatgagtaaagtttaaacattaaagattcttgtgatacagtc

SEQ ID NO: 130 - DNA, 1652 bp, Mus musculus
cccgcccgcccgctgctgcggaaggcgcagtgctcagtaaagcgcacttcctctgctggtctccaccgagggagtgcccgctccaagagctccaagccgcatcggtcctgctctgatccgaaggcgcagacatgtcggaacaaagtaaggacctgagcgaccctaactttgcagccgaggtccccgactgtgagatgcaggacagcgatgccgttccggtggggatccctcctcccgcttctctggccgctaacctcgcagggccaccgtgcgctcccgaaggccctatggcagcccaacaggcctcgccaccgcccgaagaacggatagaagatgttgaccctaaaatcctgcagcaggccgcagaggagggccgcgcccaccagccccagagtccagcccggccgatcccagcaccgccagcccctgcccagctggtgcagaaggcgcacgagctcatgtggtacgtgttggtgaaggaccagaagaggatggtcctctggtttccagacatggtgaaagaggtcatgggcagctacaagaaatggtgcagaagcatcctcaggcgcaccagcgtcatcctcgccagagtgttcgggctgcacctgaggctgaccaatctccacaccatggagtttgccctggtcaaagccctcagcccagaggagctagacagggtggcgctcaacaaccgtatgcccatgacaggcctcctgctcatgatcctgagcctcatctatgtgaagggccgcggggccagagagggtgcggtctggaatgtgctgcgcatcctggggctgaggccctggaagaagcactccaccttcggagacgtgaggaagataatcaccgaggagttcgtccagcagaattacctgaagtaccagcgtgtgccccacatcgagcctcccgagtacgagttcttctgggggtccagagctaaccgtgaaatcaccaagatgcagatcatggagttcctggccagagtcttcaagaaagatccccaggcgtggccttcccgatacagggaggctctggagcaggccagagctctgcgggaggctaatcttgctgcccaggccccccgcagcagtgtctctgaggactaaaaaggtccaggggcacactgatagtttctgacccatactagggctgtgtaagggtggggttgagtcattagagtatcccaaatccacagtgcagtatttcatgtataatttttaagttttccatacagtgcttttgtaccttgtaatgctattcatttgtgtactcgtgtagtgtttaagattgatgcatgtgtgataagtatttggtactttcacttttgtgctttcgtgcatttttgtacaagagatgtgctgtgctaaacttgtgaaatacattgaggtgttctgtatcttgttctttgtatgggactgatgatctgtatcgacaaagaaggccctggagagttagcaggacttaacagcaacgcagacctgagcaagagaaaggtcaaggcctttctccatatgacttcaactggcacaggaagcatccatgtggaatggactgatttgaactggactgttctcagtgtaggcacttagcaccctttacaaaacatgtatgcaaccccaccataaataaacgttaaaatgagcattaaa

SEQ ID NO: 131 - DNA, 1634 bp, Rattus norvegicus
cactgaggcagtgcaggctccgagagctccgagtcgcagcggtcctgctctgatcaaaagacgcagaatgtcggaacaaagtaaggacctgagcgaccctaactttgccgctgaggaccccgacactgagatgcaggtcagcgatgctgttccggtgggggtccctcctcccgctcctctggccgcgaacctctcagggccatcgtgcgctccggaaggccctatggcagccccacaggcctcgccaccacctgcagaacggtttgaagaggttgaccctaagatcctgcagcaggccgcagaagagggccgcgcccaccagccccagagcccagcccggccgatcccagcaccgccggcccctgcccagctggtgcagaaggcgcacgagctcatgtggtacgtgttggtcaaggaccagaagaggatggtcctctggcttccagacatggtgaaagaggtcatgggcagctacaagaagtggtgcagaagcatcctcaggcgcaccagcgtcatcctcgccagagttttcgggctgcacctgaggctgaccaatctccacaccatggagttcgccctggtcaaagcactcagcccagaagagctggacagagtcgcgctgaacaaccgtatgcccatgacaggtctcctgctcatgatcctgagtctcatctatgtgaagggccgcggggccagagagggtgcggtctggaatgtgctgcgcatcctggggctgaggccctggaagaagcactccaccttcggagatgtgagaaagattatcaccgaggagttcgtccagcagaattacctgaagtaccagcgtgtgccccacatcgagcctcccgagtacgagttcttctggggccccagagctaaccgtgaaatcaccaagatgcagatcatggagttcctggccagagtctttaagaaggatccccaggcttggccttcccgctacagagaggctctggagcaggccagagctctgcgggaggctaatcttgtcgcccaggccccccgcagcagtgtctctgaggactaaaatgtccaggagcacattgatagtttctgacccatactagggctgtgtaagggtggggttggacattagagtatcccagattcatagtgcagtatttcatgtatagtttttaagttttccatccagtgctttttttatcttgtaatgcaatgtattcagttgtgtactcgtgtagtgtttaaaattgatgcatgtgtgttttataagtgagcaagttggtactttcacttctgtgctttcttggatttttgtacaagagatgtgctgtgctaaacttgtgaaatacattgaggtgttctgtatcttgttctttgaatgggactgatggtccgtatcgacaaagaaggccctggagagttagcaggacttaacaacaacacagacctgaccaagagaaaggtcagggtccctctccatatgactccaactggcacaggaaacatccatgtggaatggactgatttgaactggactgttttcagtttaagcacttagcacactttgcaaaacatgtatccaaccccaccataaataaactttaaaatgagcattaaaaaaaaaaaaaaaaaaaaaaaaaaaaaaaaaaagg

SEQ ID NO: 132 - DNA, 1338 bp, Homo sapiens
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 133 - DNA, 1257 bp, Homo sapiens
taggtggcgggcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctgtgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccgcaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagcctcgctgcatttgctctctcgattcccctttcctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagtagaggcgcaccaaaaaaaaaaaaaaaaaaaaaaaaaaaaaaaaaaaaaa

SEQ ID NO: 134 - DNA, 2533 bp, Pan troglodytes
gcaacgggtacaaagaaccccactggctaaggccgacctaccagggcttgggggaggggagcggaagacagaggtcgaaacgacctgtccagcagaaaactgtccccgagcatattccaaccacttctccgtagagctcattccttccgtgcatacgaagggcgccaatccttcctgtatccctcccacagataccgggtgactactgcttttgcgcccaaagcgcagtgctctggctcagctccctacagtagcgacctccaccgcagattctcatctcctcgctaccgtaagagagatgtaaagaatcagacgggttacgcgctcaggcaccctcatgaagcagaggacctgggcttaaaactcattcagtattaggaaaagagcgccgagcacgggcctattatgccaaagcttctgaaaggggcaccacgttttttgctctatggggcagatgacccctccctaatttcggttttccatccatccccaaggtaggctttggagtggcaccggagactgagctcaaatttgcaggccagggactggggagaagggcgccacactaagacctgcacccccattctcgccctgtactctacccagagtcgtggtacccctccattttaaagcaaaatccaaaagcaagcacggcggaatcttctggaagggggctaagatggaactcaggagcgggggtcggtatggaaagagcagatgatttttttcctctcctggcgaatgaggagcgccccccagccacccctcctcataacaccccccaaggcgcgcatgcgcacttaggtggcgagcgggtacttaaggcgcggccaccgcggctgcggcagtgcgcccaacagcggactccgagaccagcggatctcggcaaaccctctttctcgaccacccacctaccattcttggaaccatggcggcagtggcggcggcctcggctgaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcatacacggtgtcgcggaccgggcggcaggtgttgggggagcgcaggcagcgagcccccaactgaggccccagctcccagccctgggcggccgtatcatcaggtgctcctgtgcatctcggccagcacgggagccagtgccgcgcaggaatgtggggtcccctctgttccctcgccagaggagcacttggcaaggtcagtgaggggccagtagacccccggagaagcagtaccgacaatgacgaagataccagatcccttcccaacccctttgcaccggtcccactaaggggcagggtcgagagaggaggggggatagggggagcagacccctgagatctgggcataggcaccgcattctgatctggacaaagtcgggacagcaccatcccagccccgaagccagggccatgccagcaggccccaccatggaaatcaaaacaccacaccagccagcagaatggacattctgacatcgccagccgacgccctgaatcttggtgcagcaccaaccgcgtgcctgtgtggcgggactggagggcacagttgaggaaggagggtggttaagaaatacagtggggccctctcgctgtcccttgcccagggcacttgcattccagccttgctgcatttgctctctcgattccccttttctcctcactgcctcccaagcccaccctactccaaaataatgtgtcacttgatttggaactattcaagcagtaaaagtaaatgaatcccacctttactaaaacactttctctgaaccccccttgcccctcactgatcttgcttttccctggtctcatgcagttgtggtcaatattgtggtaatcgctaattgtactgattgtttaagtgtgcattagttgtgtctccccagctagattgtaagctcctggaggacagggaccacctctacaaaaaataaaaaaagtacctcccctgtctcgcacagtgtcccaggaccctgcggtgcagcggaggcgcgccaaaactttgtctcttgtgatttctttagcggcatcaacatgcacttctaagactcagctgatgtgcccactgtggaacaggcacactgcttgggggagggaggaaaaaggagggccatcaaaattgcaataagctgggcccctcacacacccaaccccatctcaatgctgtcctgtgataaaggaccatctccccctctccccaaagagaaaggctgacatcttcacttgtggtcctggaataagggaccacttccccctccccaaagggataggtgctttacttgtggtcttaggataaggggccaaagcaggtatcactttgggaaagatgagaggaggggaaaaaggtgggagtagccctccaaagaggtagtagggaccaagggggtgatttcagaacacaaagccttacttcaggtctccatccagg

SEQ ID NO: 135 - DNA, 567 bp, Canis lupus
gcccaacagcggactccgagagatcggcggacctcggcgaaccgcgctcgctctcaacccaccgctctcggaaccatggcggcagtagcggcagcctcggctgagctgctcatcatcggctggtacatattccgtgtgctgctgcaggtgttcctggaatgctgcatttactgggtaggattcgcttttcgaaatcctccagggacacagcccattgcgagaagtgaggtgttcaggtactccctgcagaagctggcatacacggtgtcgaggaccgggcggcaggtgttgggagagcgccggcagcgagcccccaactgaggccccagcccccagccctgggcggcctcgtcaccaggtgctcctgtgcttctcagccagcatgggagccagtgccgcacaggaatggggagtcccctgtgctctctcgccagaggagcatttgccaaggtcagtgaggggccggtaggcccccggagaagcagaaccgacaatgatgacaataccagatcccttccaaacccctttgcacccctccgactgctgggcggggtagagggaaggggg

SEQ ID NO: 136 - DNA, 1223 bp, Mus musculus
attgcgcccagcagcggactccgagaccagtagacctcggcgaacccttgctctcgaccacccacccactttcggaaccatggccgcagtggcagcagcctcggcagaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcgcacacggtgtcccggaccgggcggcaggtgctgggggagcgcaggcagcgagcccccaactgaggccccagctcccagccctgggcggccgtgtcatcaggtgctcctgtgcttctcgaccagcatgggagccagtgccgcgcaggaatggggggtcccctgtgttccctcgtcagaggagcacttgccaaggtcagtgaggggccggtaggcccccagaaaagcagcaccgacaatgatgaagatatcagttcccttcccagcccctttgcccctgtcccactaccggcgggtgggagaggaggggggaagaggggagcaaccctcgagatatgggcgtaggcaccacattctgatctggaccaagtcggaacagtaccatctcagccgcacaagatcctaccatgaagatcgaacagcccatcaaccagcagaatggacattctgacatcaccagctgaagccctacatctcggtgcagaagagaaagtgtcaactgtgtgcagcatggggggagtggagggcgtgggtggtggaggaagagggttaagaaaactagtggggcccccttgctgccccttgcctatggcacacatattcctgccttgctccctcatttccccttttccccccgccttcgaaagccctccccaaaatgtgtcacttgatttggatatattcaaccagtaattgaatcccacctttaccaaaacacgttctctaacccccggcccttcactgatcttgcttatccctggtctcacgcagcagttgtggtcaatattgtggtagtcgctaattgtactggtttaagtgtgcattagtagtgtctccccagctagattgtaagctcctggagacagggaccacctccaccaaaaataaaaaaatggacctctcctgtcttgtagtgtcctaggaccctgcagggcagtgggggtgcaccaaaaaaaaaaaaaaa

SEQ ID NO: 137 - DNA, 1142 bp, Mus musculus
attgcgcccagcagcggactccgagaccagtagacctcggcgaacccttgctctcgaccacccacccactttcggaaccatggccgcagtggcagcagcctcggcagaactgctcatcatcggctggtacatcttccgcgtgctgctgcaggtgttcaggtactccctgcagaagctggcgcacacggtgtcccggaccgggcggcaggtgctgggggagcgcaggcagcgagcccccaactgaggccccagctcccagccctgggcggccgtgtcatcaggtgctcctgtgcttctcgaccagcatgggagccagtgccgcgcaggaatggggggtcccctgtgttccctcgtcagaggagcacttgccaaggtcagtgaggggccggtaggcccccagaaaagcagcaccgacaatgatgaagatatcagttcccttcccagcccctttgcccctgtcccactaccggcgggtgggagaggaggggggaagaggggagcaaccctcgagatatgggcgtaggcaccacattctgatctggaccaagtcggaacagtaccatctcagccgcacaagatcctaccatgaagatcgaacagcccatcaaccagcagaatggacattctgacatcaccagctgaagccctacatctcggtgcagaagagaaagtgtcaactgtgtgcagcatggggggagtggagggcgtgggtggtggaggaagagggttaagaaaactagtggggcccccttgctgccccttgcctatggcacacatattcctgccttgctccctcatttccccttttccccccgccttcgaaagccctccccaaaatgtgtcacttgatttggatatattcaaccagtaattgaatcccacctttaccaaaacacgttctctaacccccggcccttcactgatcttgcttatccctggtctcacgcagcagttgtggtcaatattgtggtagtcgctaattgtactggtttaagtgtgcattagtagtgtctccccagctagattgtaagctcctggagacagggaccacctccaccaaaaataaaaaaatggacctctcctgtcttgtagtgtcctaggaccctgcagggcagtgggggtgcaccaaaaaaaaaaaaaaa

SEQ ID NO: 138 - DNA, 1178 bp, Rattus norvegicus
gcgaacccttgctctcgaccacccacccactttcggaaccatggccgcagtggcagcagcctcggcagaactgctcatcatcggctggtacatcttccgcgtgctgctgcaggtgttcctggaatgctgcatttactgggtaggattcgcttttcgaaatcctccagggacacagcccattgcgagaagtgaggtgttcaggtactccctgcagaagctggcgcacacggtgtcccggaccgggcggcaggtgctgggggagcgcaggcaccgagcccccaactgaggccccatctcccagccctgggcggccgtgtcatcaggtgctcctgtgcttctcgaccagcatgggagccaatgccgcgcaggaatggggggtcccctgtgctccctcgtcagaggagcacttgccaaggtcagtgaggggccggtaggtccccagaaaagcagcaccgacaatgatgaagacatcagttcctttcccagccccccccccctttgcccctgtcccatggccggcgggtgggagaggatgggggaagaggggagcaaccctcgagatatgggcgtaggcaccacattctgatctggaccaagttggaacagcaccatctcagccgcacagatcctaccatggagagctaacaccccaccaaccagcagaatggacattctgacatcaccagctgaaaccctgaatctcggtgcagaagagaaagtgtcaactgcgtgcagcactgggggagtggagggtgtgggtggtggaggaagagggttaagaaaactagtggggccctcttgctgtcccttgcctatggcacgcatattcctgccttgctccctcactccccctctcccctgccttccaaagccccaccccccaaaaatgtgtcacttgattcggacctattcaaccagtaattggatcccacctttaccaaaacaccgtctctgacccccggcccttcactgatcttgcttatccctggtctcacgcagcagttgtggttgctattgtggtagtcgctaattgtactagtttacgtgtgcattagttgtgtctccccggctagattgtaagctcctggagacagggaccacctccacaaaaaataaaaaaacggacctctcctgtcttgtagtgtgctaggaccctgcagggcagtgggggtgcacca

SEQ ID NO: 139 - DNA, 1097 bp, Rattus norvegicus
gcgaacccttgctctcgaccacccacccactttcggaaccatggccgcagtggcagcagcctcggcagaactgctcatcatcggctggtacatcttccgcgtgctgctgcaggtgttcaggtactccctgcagaagctggcgcacacggtgtcccggaccgggcggcaggtgctgggggagcgcaggcaccgagcccccaactgaggccccatctcccagccctgggcggccgtgtcatcaggtgctcctgtgcttctcgaccagcatgggagccaatgccgcgcaggaatggggggtcccctgtgctccctcgtcagaggagcacttgccaaggtcagtgaggggccggtaggtccccagaaaagcagcaccgacaatgatgaagacatcagttcctttcccagccccccccccctttgcccctgtcccatggccggcgggtgggagaggatgggggaagaggggagcaaccctcgagatatgggcgtaggcaccacattctgatctggaccaagttggaacagcaccatctcagccgcacagatcctaccatggagagctaacaccccaccaaccagcagaatggacattctgacatcaccagctgaaaccctgaatctcggtgcagaagagaaagtgtcaactgcgtgcagcactgggggagtggagggtgtgggtggtggaggaagagggttaagaaaactagtggggccctcttgctgtcccttgcctatggcacgcatattcctgccttgctccctcactccccctctcccctgccttccaaagccccaccccccaaaaatgtgtcacttgattcggacctattcaaccagtaattggatcccacctttaccaaaacaccgtctctgacccccggcccttcactgatcttgcttatccctggtctcacgcagcagttgtggttgctattgtggtagtcgctaattgtactagtttacgtgtgcattagttgtgtctccccggctagattgtaagctcctggagacagggaccacctccacaaaaaataaaaaaacggacctctcctgtcttgtagtgtgctaggaccctgcagggcagtgggggtgcacca

SEQ ID NO: 140 - DNA, 3054 bp, Homo sapiens
tcggcacgagcgtggctcggttcttgtgagcgaagctttgtccggttcggcaatggacggaatcgtcactgaagttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctggcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatcccttagtttgtaattaagatttggaatatggttgtggatttctgagcatgtgcagactggtctagctagttccaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaaaaaaaaaaaaaaaaa

SEQ ID NO: 141 - DNA, 3535 bp, Pan troglodytes
gcggaggcgcggaggaggcgtcggctgcggcgcccactccccctagtcctagcgccccgccgctcgcctcccgctgccgggcgccggcgcgctcggctctttccgccgccgctgctgccgcgcggtggcccgtgcgcctcggcaccttcggcaatttccgtcgggccccagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactgaagacagataatacattaaaccaagcacgtgctcaagcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctctgcctcctgggttcacgccattctcctgcctcagcctcccaactgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttgtacaataagaaagacagcgctctaatacagatggctgacggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttctttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttcctttcaacttagttgacatatgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaacctttttgtacacactcttgtgggacgtatcatataaatgtcagcactaagtaatgtcttgtttgtggctgaatatttttcgtagatgtttttgaagttgacatgacttacatgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaagttgggaggtttgatggttgtttaatttcattttgtgtgtactctgcttacccctgtagcatgctcaataaaacttctgtagctctatattcaccttttctgtctttctctgctgccttttctctctcctcttctttgttttcactccactgtgcttctgaattcatgtttattctctgccagggtgggaaaggagtaataatattacaattctatggctttataccataaataaatctagatgctgtgaaaata

SEQ ID NO: 142 - DNA, 3337 bp, Canis lupus
cgccgctcgcctcccgccgccgggcgccggcgcgctcggctctttccgccgccgccgctgccgcgcgctgccccgtgcgctccggcaccttcggcaatttccgtcgggccccggccgccattttctcgccgcttgtgtgtctcgctggctgcgtggctcggttcctgtgagcgaagctttgtccggttcggcaatggacggaattgtcactgaggttgcagttggcgtgaagccaatggtaatgatagcaagaaatttaaaggagaagataaaatggatggtgctccttctcgtgtacttcatattcgaaaattacctggtgaagtgacagaaacagaagttattgctttaggcttaccttttggtaaggtgaccaacatccttatgctgaaaggaaaaaatcaggcatttttggaactagcaacagaggaagcagctattactatggttaattactattctgctgtgacacctcatctccgtaaccaaccaatttatatccagtactccaatcacaaagaactaaaaacagataatacgttaaaccaacgtgctcaagcagttcttcaagctgtgacagctgtccagacagcaaatactcctcttagtggcaccacagttagtgagagtgcagtgactccagcccagagtccagtgcttagaataattattgacaatatgtactaccctgtaacacttgatgttcttcaccaaatattttctaagtttggtgctgtattgaagataatcacatttacaaaaaataaccagtttcaagctcttctccagtatggtgatccagtaaatgctcaacaagcaaaactagccctagatggtcagaatatttataatgcttgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacctccctcttagctgttccaggagctctgagtcctttggctattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttgtacaataagaaagacagtgctctgatacagatggctgatggaaaccaatcacaacttgccatgaaccatcttaatggacagaaaatgtatggtaaaattattcgtgttaccctgtctaaacatcagacggtacaactacctcgagagggacttgatgatcaagggctaacaaaggattttggtaattccccattgcatcgttttaagaaacctggatccaaaaattttcagaacatttttcctccttctgcaacccttcacctatccaatatccctccttcggtagcagaagaggatctacgaacactgtttgctaacactgggggcactgtgaaagcatttaagttttttcaaagagatcacaaaatggctcttcttcagatggcaacagtggaagaagctatccaggccttgattgatcttcataattacaaccttggtgaaaaccatcatctgagagtgtctttctccaagtcaacaatttaaaaagggggaggtgaagattgagggtgtatcacattgtttggtgtcatcacctattgactgttcagaaaagtggggaccagagtttgatttttttgttgttgttgttgtttcctttttttttccatgctgttatcattccttggttataaaatgaaatggcatacataaaggcagagttgttaactgctgtatttcatctgttctataggtaggccatttttattgtctgtttataattttagtttaattatactttcctttttcaacttagttgacatacgtgccttaaaaaggaaaactagtgttgctattgtgcatttactaggtaaaaggaattggttgtctagggcacattgttatatgggaattacaatatgtttaggcaggggtgtgtaaaaaggttaagtttttgtttctcctgcttggaacttattttgaattattggcttgtcacatttctttctatttaatcaaataagatacatgatactgaaagaattaaagcagcattttttagtttttactaccttaggctttattgctttaaaaaaacattggccttttgtatctcacaattctggtctagattcagttatgaatgtaggcattagttaaaattaacaagatgcagagtattaatttcttaagacaacaaagtgatttctgtaagtttgagccctacgtggaaagcattgtggaatcttaacctttttgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatttgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatctgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaagttgggaggtttgatggttgtttaatttccttttgtgtgtactctgcttacctctgtagcatgctcaataaacacttctgtagctctgtattcaccttttctgtctttctctgctgccttttctctttcctcttctttgtttttcactccactgtgcttctgaattcatgtttattctctgccagggtgggaaaggagtaataatattataattctatggctttataccataaataaatctagatgctgtg

SEQ ID NO: 143 - DNA, 3061 bp, Bos taurus
cggctgcgtggctcggttcttgtgagcgaagctttgttcggttcggcaatggacggaattgtcactgatgttgcagttggcgtaaagagaggatctgacgaactactctcaggcagtgttctcagtagtccaaactctaacatgaccagcatggtggttacagccaatggtaatgatagtaaaaaattcaaaggagaagataaaatggatggtgctccttctcgtgtacttcatattcgaaaattgcctggtgaagtgacagaaactgaagttattgctttaggcttaccttttggtaaggtgaccaacatccttatgctgaaaggaaaaaatcaggcatttttggaactagcaacagaggaagcagctattaccatggttaattactattctgctgtgacacctcaccttcgtaaccaaccgatttatatccagtactccaatcacaaggaactaaaaacagataatacattaaaccaacgtgctcaagcagttcttcaagctgtgactgctgtccagacagcaaatactcctcttagtggcaccacagttagtgagagtgcagtgactccagcccagagtccagtgcttagaataattattgacaatatgtattatcctgtaacacttgatgttcttcaccaaatattttctaagtttggtgctgtattgaagataatcacatttacaaaaaataaccagtttcaagctcttctccagtatggcgatccagtaaacgctcagcaagcaaaactagggatcttccggacccagggatcgaacccaggtctaccgcatttcaggcagatgctttaacctctgaatcaccagggaagccctcaaggccctagatggtcagaatatttataatgcttgctgtaccctaaggattgatttttccaagcttgtgaatttgaatgtaaaatacaacaatgataaaagtagggattatactcgacctgatcttccatctggggatggacaacctgcattggacccagctatagctgcagcatttgccaaggaaacatctctcttaggtatgatttttattgtctgtaccacttctgccaaatgggcaagtgcctgttaaactccagtaagtataatgaatctcccattttgaattttaagaaattatgttagatccccccaccccctcaggtaagaatgtatatgaatactgttggaagaaaaacctaaattcataagtataattaaagttgtgtcacattgctttgacctatctcatcttctctcccaaaatagaagaggaaaagctctaatgaaaaaatactgttgagttcttaataaaacatttacactttaaagtcatgctatctagaagccattgtgcatattcagtcttaattgtttcagttagattggaaaaccaatctgattgtttcagtttagctctgcacaaaaaaaacccagaaagttaacagaggcagcatataatgggagtaggtatatggatttttcaaaacatatcgtagtcttaaaacacaggtttaactaggaagaattttatataaaattttttttggtatttatttgcattttgtcttagttattatatttcacctcattcagcaatgggtttgacccacctaataaaaaaaacacaaatatttgcaactaatagttgacagagtcaagatgaagaaaaaataacagaaaatgttattttgtaagtaaaataagtgatttataacttcagatgacattttagtttccttttgatgaattcaggaaattcttggtttctgaagtttgtaagattatcattaaatgaatgtttctggacgtatggaacccaagattgatgaatcgcaaacttgttcttagagtttagcttattgctattattcagttgctaagtattatccaactctttgtgtccccatggactgtagcatgccaggctcctctatccactgtctcccggagtttgatgaacataagttgagcttacattcatcaatgtaaaaagaaaaagcatcacttatttagtgtggatatgtaacatgtgttatccatttataaatatgttatataagtgatacatcatctatgaacagagagacactaatgcacaagagaagcatttgatatttgaaattaattctgataattttagacaaaacttaaccttattctgattgtctaataacaacttgcagaaattatagcagtttgtcataataaatttatcatgataaatttatcataatgaattctttaggttgataacattctttcctgagagaatctccatcactctgtgggcttagtttaaagctttatttcctcaacttggcttgtaagtaaataatattaacaattttatggtgtaccatttttttaaagtcaagaatgagacagtaatgaatgaatcatggcctttgcttgtaattgttactatgaattcttaattttttactgatagaacttatagaaaagacaaaaatcaacatttattgaatagcttctagatcctaggggttctgcaaggtacttggcagatacattatttaattcttaaagtaaccaaagtagaagatgatacgaagattttatagtcatttctaaggagtttaaaattttactttgaactcattaaagaaacaatggtaaaagaccgagaaatttcagctagtttcaaacatagtacttccttagacccgtaatcacttcctgggaccctaagagctatgtgtatttgcctattgggggggtagttgatgaatttatgtatgttttttggattctggttggagtcatggatttgtctatggagtttatcatttttcttgtaatggccttgttggaattcttttttagagtaataataaataagaaatctttctcataaaagattatacaatcctggcataacttaacttttgtcttattcagtgcttttatcatttctcaagtgttctacatttttgcattaaaagaatgtgagtaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 144 - DNA, 2997 bp, Mus musculus
ctggctgcgtggctcggttcttgggagcgaagctttgtccggttcggcaatggacggaattgtcactgaggttgctgttggtgtgaagagaggatctgacgagctactctcaggcagtgttctcagcagccccaactctaatatgagtggcatggtagttacagccaacggtaacgatagtaagaaatttaaaggagaagataaaatggatggggctccctctcgtgtacttcacattcgaaagttacctggtgaagtgactgaaacagaagttattgctttaggtttaccttttggtaaggtgactaacatccttatgctgaaaggaaaaaaccaggcatttttggaactggcaacagaggaagcagctattactatggttaattactattctgctgtgacacctcatcttcgtaaccaaccaatttacatccagtactccaatcacaaagaactaaagacagataatacattaaaccaacgtgcgcaagtagttcttcaagctgtgacagcggtccagacagcaaatacacctcttagtggcaccacagtcagtgagagtgcggtgactccagcccagagtccagtacttagaataattattgacaatatgtactaccctgtaacacttgatgtccttcaccaaatattttctaagtttggtgctgtattgaagataatcacatttacaaaaaacaaccagtttcaggctttgctccagtatggtgatccggtaaacgctcaacaagccaagctagccctagatggtcaaaatatttataatgcttgctgtaccctaaggattgatttttccaaacttgtgaatttgaatgtaaaatacaacaatgataaaagtagggattatactcgacctgatctgccatctggagacggccagcctgcgttagacccagccattgctgcagcatttgccaaggagacatccctactagctgttccaggggctctcagtcctttggctattccaaatgctgctgcagcagctgctgccgctgccgctggccgagtgggcatgcctggagtctcagctggtggcaatacagtcctgttggttagcaatttaaatgaagagatggttacgccccaaagtctgtttaccctcttcggtgtttatggagatgtgcagcgcgtgaagattctgtacaataagaaagacagtgctctgatacagatggctgatgggaaccagtcccagctcgccatgaatcatcttaatgggcagaagatgtatggaaaaattattcgtgttactctctctaaacatcagactgtgcaactacctcgagagggacttgatgatcaagggctaacaaaagattttgggaattcaccactgcaccgttttaaaaaaccgggatccaaaaactttcagaacattttccctccttctgctacccttcacctgtctaacatccccccttctgtagcagaagaggatctgcgaactctgtttgccaacaccgggggcactgtgaaagcatttaagttttttcaaagagatcacaaaatggctcttcttcagatggcaacagtggaggaagctattcaggctttgattgatcttcataattataaccttggagaaaaccatcatctgagagtgtctttctccaagtcaacaatctaagcacgggagatgaagatggcgggcagatcccattgttggtgtcatcacctattgactgttcagaaaagtgggggaccagagtttgatttttttcatgctgttatcattccttggttataaaatgaaatggcatatgtaaaggcagagttgctaactgctgtgtttcatctgttcaatagggaagccatttttgtctgtttaaatttttagtttaattttgctttttttttttttttccaacttagttgacatacgtgccttacaaaggaaaactagtgttgctattctgcatttactaggaaaaaggaattggttgtttagggcacatcgttatgtgggaattaaaatatgtttgggcaggggtgtgtcaaaaggttaagtttttatttctcctgcttggaactttctttgaattattggcttatcacatttctttctatttaatctaataagatacttgatactgagagtataaaacagcatttttagtttttactatcttaggctttattgcttttgaaaacattggccttttgtatctcacaaatctggtctagattcagttatgaatgtaggcattagttaaaattaacaagatgcagagtattaatttcttaagacaagtgatttctgtaagtttgagccctatgtggaaagcattgtggaaccttaacctttttgtacacactcttgtgggacgtgtcatataaatgtcagcactaagtaatgtcttgtttgtggctgaatatttttcgtagatgtttttgaagtgacatgactacgtgcatttaaatatatattgccatccttagtttgtaattaagatttggaaaatggttgtggatttctgagcatgtgcagactggtctagctagttcaggaactggtgcatgtatttttcaaagacaaagaaagtgtactgcgaaaacttgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaatttatttgaacagttcttgtcaatctgaattgttgattctgttaaatgaccaatactttttgaaattgatgtacttagtttcaagattcatagattctgttatctatgtagacagaatggtcatgtatattttctattagttgagtttttacatctttagaaatgtaaaattgtatagtttgaaagcggcacaattaaaaattaattttctaacaaaaaaaaaaaaaaaaaaaa

SEQ ID NO: 145 - DNA, 1842 bp, Rattus norvegicus
cctggccgccattttctcgccgcttgtgtggctcgctggctgcgtggctcggttcttgggagcgaagctttgtccggttcggcaatggacggaattgtcactgaggttgctgttggtgtgaagagaggatctgacgagctactctcaggcagtgttctcagtagtcccaactctaatatgagtggcatggtagttacagccaatggtaacgacagtaagaaatttaaaggagaagataagatggacggggcgccctctcgtgtgcttcacattcgaaagttacctggtgaagtgactgagaccgaagtaattgcgttaggcttaccttttggtaaggtgactaacatccttatgctgaaaggaaagaaccaggcatttttggaactggcaacagaggaagcagctattactatggttaattactattctgctgtgacacctcatcttcgtaaccaaccaatttacattcagtactccaatcacaaagaactaaagacagataacacattaaaccaacgtgctcaagtagttcttcaagctgtgacagctgtccagacagcaaatacacctctcagtggcaccacagtcagtgagagtgcggtgactccagctcagagtccagtgcttagaataattattgacaatatgtactaccctgtaacacttgatgtccttcaccaaatattttctaagtttggtgctgtattgaagataatcacatttacaaaaaacaaccagtttcaggctttgctccagtatggtgatccagtaaacgctcaacaggcaaagctagccctagatggtcaaaatatttataatgcttgctgtaccctaaggattgatttttccaaacttgtgaatttgaatgtaaaatacaacaatgataaaagtagggattatacacgacctgatcttccatctggagacggccagcctgcattagacccagctattgctgcagcatttgccaaggagacgtcccttttagctgtcccaggagctctcagtcctttggctattcctaatgctgctgcggcagctgctgccgctgccgctggccgagtgggcatgcctggagtctcagctggtggcaacacagtcctgttggttagcaatttaaatgaagagatggttacgccccaaagtctgtttaccctcttcggtgtttatggcgatgtgcagcgcgtgaagattttgtacaataagaaagacagtgctctgatacaaatggccgatgggaaccagtcacagcttgccatgaatcatcttaatgggcagaagatgtatggaaaaattattcgtgttactctctctaaacatcagactgtgcaactacctcgagagggacttgatgatcaagggctaacaaaagattttgggaattcacccctgcaccgttttaaaaaaccgggatccaaaaactttcagaacattttccctccttctgcaacccttcacctgtccaacatccctccttctgtagcagaagaggatctgcgaactctgtttgccaacaccgggggcactgtgaaagcatttaagttttttcaagatcacaaaatggctcttcttcagatggcaacagtggaggaagctattcaggctttgattgatcttcataattataaccttggtgaaaaccatcatctgagagtgtctttctccaaatcaacaatttaaggacgggagatgaagatggcgggcagatcccattgtttggtgtcatcacctattgactgttcagaaaagtggggaccagagtttgattttttcatgctgttctcattccttggttataaatgaaatggcgtatgtaaaaaaaaaaaaaaaaaaaaaaaaaaa

SEQ ID NO: 146 - DNA, 2005 bp, Homo sapiens
caacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctataaaaaaaaaaaaaaa

SEQ ID NO: 147 - DNA, 2044 bp, Pan troglodytes
aagaaaactctggctgtgccccagcgacggctcattctgctcccccgggtcggagccccccggagctgcgcgcgggcttgcagcgcctcgcccgcgctgtcctcccggtgtcccgcttctccgcgccccagccgccggctgccagattttcgggcccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctaggctcggcgcgcgggctcttcctcttcggccagcccgacttctcctacaagcgcagcaattgcaagcccatcccagccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccggccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaaacgcatctcccgcagcatccgcaagctgcagtgctagtcccggcatcctgatggctccgacaggcctgctccagagcacggctgaccatttctgctccgggatctcagctcccgtttcccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacagtacttccatttattaaaagcacattaaccatttctatagcatgatttcttaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctttgtcttctgtcttgtcttcttagt

SEQ ID NO: 148 - DNA, 1760 bp, Canis lupus
attcggcacgaggatgccgcggggccccggctcgctgctgctgctcgtcctagcgtcgcactgctgcttgggctcggcgcgcgggctcttcttcggccagcccgacttctcctacaagcgcagcaactgcaagcccatcccggccaacctgcagctgtgccacggcatcgagtaccagaacatgcggctgcccaacctgctgggccacgagaccatgaaggaggtgctggagcaggcgggcgcctggatcccgctggtcatgaagcagtgccacccggacaccaagaagttcctctgctcgctcttcgcccccgtgtgcctcgacgacctggacgagaccatccagccgtgccactctctctgcgtgcaggtgaaggaccgctgcgccccggtcatgtcggccttcggcttcccctggccggacatgctcgagtgcgaccgattcccccaggacaacgacctctgcatacccctcgctagcagcgaccatctcctgccggccaccgaggaagctccaaaggtatgcgaagcctgcaaaaataaaaatgaggatgacaacgacataatggaaactctttgtaaaaatgattttgcactgaaaataaaagtgaaggagataacctacatcaacagagataccaaaatcatcctggagaccaagagcaagaccatttacaagctgaacggtgtgtctgaaagggacctgaagaaatccgtgctgtggctgaaagacagcctgcagtgcacctgcgaggagatgaatgacatcaacgcgccttatctggtcatgggacagaaactaggtggggagctggtgatcacctcagtgaagcggtggcaaaaggggcagagagagttcaagcgcatctcccgaagcatccgcaagttgcagtgctagtttgcccccccctccccaggccgcctccagagccaggctgaccacttccgctctgggtccccagctctcatccccccaagcacaggcccttgcagctctggccccagcctggagcagcttcccttgccttttgcacgtttgcaccctggcatctcctgaattataaggccttaggaagcttcaggagtggatactgttttaaacatacgggaggaacccacccagatcttgtagaaatgttcaaactaataaaatcatggaatatttttacggaagtttttaaatagctcaactttagttttgaataggtacagctgtgacttgggtctgactttccttctttctgtttggtttgggccaactgattttcaatttcgtggtaaggttgccgtaacgtgcaaatggcttcatttttcgatgtggcccaaaatgtggtgggtcacaatccttcgttgagataaagctggctgttattcgacgtttctcagctccagcctgagacttcagagcctaagtcttataataattcacctgtcattttatgcccccgttgggaacttacaacagtagcagcatgtactgatttccgggtagagtacttccatttatcaaaagcacattaaccaccatagcatgattcttcgaataaagggcaaaacagattttataattgacctgagtactttaagcttttgtttaaaacattttttacttaattttgcaaattaaaccattgtagcttacctgtaatatacatagtagttgaccttaaaaagttgtaaaaatattgctttaaccaacactgtaaatatttcagataagcattatattcttgtatataaactttgcttcctgttttaaa

SEQ ID NO: 149 - DNA, 2024 bp, Bos taurus
gcggctcactctgctccccccggtcggagcccacctggagctgcgcgcaggcttgtagcgcggagcccagcgcagaacctcgcccgcgcagtccctcgcgcgccccgcgtctcggcgctgatttccaggccccggagccgcgccaagcgctgcgagcggacccgggaagagctccggcccccgccgcctccgcttcaccggcttggctccctccgcccccggggggtcgcgcacccacgatgctgcagggccccggctccctgctgctgatcgtcctcgcctcgcactgctgcttgggctcggcgcgcgggctcttcttcggccagtccgacttcccctacaaacgcagcaactgcaagcccatcccggccaacctgcagctgtgccacggcatagaatatcagaacatgcggctgcccaacctgctgggccacgagaccatgaaggaggtgctagagcaggcgggcgcctggatcccgctggtcatgaagcagtgccacccggacaccaagaagttcctgtgctcgctcttcgcgcccgtctgcctcgacgacctggacgaaaccatccagccgtgccactcgctctgcgtgcaggtgaaggaccgctgcgctccagtcatgtccgccttcggcttcccgtggcccgacatgctcgactgcgaccgcttcccccaggacaacgacctttgcatccccctcgctagcagcgaccacctcctgccggctaccgaggaagctccaaaggtatgtgaagcctgcaaaactaaaaacgaagatgacaacgacataatggaaacactttgtaaaaatgattttgcactgaagataaaagtgaaggagatcacctacatcaatagagacacgaaaatcatcctggagaccaagagcaagaccatttacaagctgaacggagtgtccgagaaggacctgaagaagtcggtgctgtggctcaaagacagcctgcagtgcacgtgtgaggagatgaacgacatcaacgcgccctacctggtcatggggcagaagctgggtggggagctggtcatcacctcggtgaagcggtggcagaaggggcagcgagagttcaagcgcatctcccgcagcttccgcaagctgcagtgctagtcccaggccagcctcgctgcggacccctcccagggccccgccgacccgcccccgctgctctgggacctcagcgtggtttcccaagcacagtccctcggctccggctccggcctggagcggcttcccctgccttttgcacgtttgcacccccagcatttcctgagttataaggccccaggaggcctcaggaacagataggtgtcttcacataaaggaaaaatccaccgaaatcttgtagaaatattccaactaataaaatcacaaggatttttatgaagtttttaaaaaggtcagttaagaactatttcacgtaggtgcaactgtgactctggcttgatttttttggtggtttggtttgggtccgtttccactgaggttgccttaacgtgcaaacagcttcacttttctgtatggcccgaactttcccttttctgttgtgggtccaaaacccggttgagataaagctggctgttatctcagcacctctctcggctgcagcctgatactcagcacctgaattgtgtaacaagtcatttgtcatttaacatccctgctgggaacttaacaactagcatgtattgcgttttgcatttccaggtagaatacttccatttataaaaaccacattaaccaccgtagcatgagttcttcaaataaaagacaaaacagaccaattttatgattgacccgagtactttaaactttgtttaaaacacttttttacttaattttgcagattaaaccattgtagcttacctgtaatatacatagtagttgaccccaaaaagttgtaaaaatattgctttaaccaacactgtaaatatttcagataaacactatattcttgtatataaactttacatcctgttttaccaaaaaaaaaaaaaaaaaaaaaaaaaa

SEQ ID NO: 150 - DNA, 2028 bp, Mus musculus
  modified_base (1575)..(1575): a, c, t, g, unknown or other
gaattcggcacgaggctcactctgctcccccgggtcggagccccccggagctgcgcgcgggcttgcagtgccttgccccggccgacctcccggcgcccggcttcgcgcgttcgcgccgcccgctgtccagagcccccacgagcagagcgagggagtcccggacgagctcgagctccggccgcctctcgcttcccccgctcggctccctccgccccccgggggtcgctagtccacgatgccgcggggccctgcctcgctgctgctgctagtcctcgcctcgcactgctgcctgggctcggcgcgtgggctcttcctcttcggccagcccgacttctcctacaagcgcagcaactgcaagcccatccccgccaacctgcagctgtgccacggcatcgagtaccagaacatgcggctgcccaacctgctgggccacgagaccatgaaggaggtgctggagcaggcgggcgcctggattccgctggtcatgaagcagtgccacccggacaccaagaagttcctgtgctcgctcttcgcccctgtctgtctcgacgacctagatgagaccatccagccgtgtcactcgctctgcgtgcaggtgaaggaccgctgcgccccggtcatgtccgccttcggcttcccctggccagacatgctggagtgcgaccgtttcccgcaggacaacgacctctgcatccccctcgctagtagcgaccacctcctgccggccacagaggaagctcccaaggtgtgtgaagcctgcaaaaccaagaatgaggacgacaacgacatcatggaaaccctttgtaaaaatgacttcgcactgaaaatcaaagtgaaggagataacgtacatcaacagagacaccaagatcatcctggagacaaagagcaagaccatttacaagctgaacggcgtgtccgaaagggacctgaagaaatccgtgctgtggctcaaagacagcctgcagtgcacctgtgaggagatgaacgacatcaacgctccgtatctggtcatgggacagaagcagggcggcgagctggtgatcacctccgtgaaacggtggcagaagggccagagagagttcaagcgcatctcccgcagcatccgcaagctgcaatgctagtttcccagtgggtggcttctctccatccaggccctgagctctgtagaccacttccgctccggcacctcatttccggtttcccaagcacagtccgggaaagctacagccccagcttggagccgcttgccctgcctcctgcatgtgtgtatccctaacatgtcctgagttataaggccctaggaggcttggaaacccatagctgttttcacggaaagcgaaaagcccatccagatcttgtacaaatattcaaactaataaaatcatgactatttttatgaagttttagaacagctcgttttaaggttagttttgaatagctgtagtactttgacccgagggcattttctctctttggtcagtctgttggcttataccgtgcacttaggttgccatgtcaggcgaattgtttctttttttttttttttttccctctgtggtctaagcttgtgggncccagacttagttgagataaagctggctgttatctcaaagtcttcctcagttccaggcctgagaatcggcatctaagtcttcaaacatttcgttgctcgttttatgccctcatgagctctgaccattgcatgcgttcccatcccagctacagaacttcagtttataagcacacagtaaccattcctcattgcatgatgccctcaaataaaaagtgaatacagtctataaattgacgagtattttaagctttgtttaaaacatcttttaattcaattttttaatcattttttttgcaaactaaatcattgtagcttacctgtaatatacgtagtagttgacctggaaaagttgtaaaaatattgctttaaccgacactgtaaatatttcagataaacattatattctttgtatataaactttacatcttgttgtacctataaaaaaaaaaaaaa

SEQ ID NO: 151 - DNA, 2143 bp, Rattus norvegicus
tgctcactctgctcccccgggtcggagccccccggagctgcgcgcgggcttgcagtgccttgcccgcgccgacctcctggctcccggcttcgcgcgctcgcgccaccgactgtccagagcccacgagcagagcgagcgagtccgggacgagctcgggctccgatcgccactcgcttccccagctcggctccctcagccccccgggggtcgctagtccacgatgctgcggggccctgcctcgctgcttctgctagtcctcgcctcgcactgctgcctgggctcggcgcgtgggctcttcctcttcggccagcccgacttctcctacaagcgcagcaactgcaagcccatccccgccaacctgcagctgtgccacggcatcgagtaccagaacatgcggctgcccaacctgctgggccacgagaccatgaaggaggtgctggagcaagcgggcgcctggattccgctggtcatgaagcagtgccacccggacaccaagaagttcctgtgctcgctcttcgcccctgtctgtctcgacgacctagacgagaccatccagccgtgtcactcgctctgcgtgcaggtgaaggaccgttgtgccccggtcatgtccgccttcggcttcccctggccagacatgctggagtgcgaccgcttcccgcaggacaacgatctctgcatcccccttgctagcagcgaccacctcctgccgcccacagaggaagctcccaaggtgtgtgaagcctgcaaaactaagaacgaggatgacaacgacataatggaaactctttgtaaaaatgacttcgcactgaaaatcaaagtgaaggagataacctacatcaacagagacaccaaaatcatcctggagacaaagagcaagaccatttacaagctgaacggggtgtccgatagggacctgaagaaatcagtgctgtggctcaaagacagcctgcagtgcacctgtgaggagatgaacgacatcaacgctccctatctggtcatgggacagaaacagggtggagagctggtgatcacctccgtgaaacggtggcagaagggccagagagagttcaagcgcatctcccgcagcatccgcaagctgcaatgctagtttcctagtggagtggcttctcgccgaccaggccctgggctccgtggaccacttccactctgcgacctcatttccggtttcccaagtactgtcgggagagctacagtctcagcttggagcagcttgccctgccttttgcatgtgtgtatcctaacgtgtcctgagttataaggccctaggaggccccgggaacagatagctattttcacataaagcgaaaagtccatccagatcttgtagaaatattcacaactaataaaatcatgactgttttttatgaagttttaaaacagctcattttaagggtagttttgaatagctgtagtactgtgacccgaggggcattttctctctttggtcagtctgttggtttatactgtgcccttaggttgccatgtcaggcaaattgtttctttttttttcccctctgtggtctaagcgtgtgggtcccagacttggtggttgagataaagctggctgttatctcaaaggctccctctgttccagcctgagactcggcgtctaaatcttcaaaggttttcattgctcattttacaccctcattaactccgaccgttgcatgcatcccagcccagctacagaacttcattttataagcacacattaaccattcctcattgcatgatgccttcaaataaagggcaacgtgaatacagtttataaatcaacgagtattttaagccttgtttaaaacatctttttactccattttttttctttttttttttcttcaaactaaatcattgtagctaacctgtaatatacgtagtagttgacctggaaaagttgtaaaaatattgctttaaccgacactgtaaatatttcagataaacattatattctttgtatataaactttacagcctgttgtatttattccttgtctttctgtcatgtctcctttgaccaaggagctgggagggagccctgtccttctcaggaggcccagccctccccccagcaggttgaagttaccagttactcggtgttttaggactcctgtccccgtacatta

SEQ ID NO: 152 - DNA, 8737 bp, Homo sapiens
acctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttcaaaaaaaaaaaaaaaaaaa

SEQ ID NO: 153 - DNA, 2352 bp, Bos taurus
atgccggacttcacctcatcatatccagaccggagaacagaggtgtggtatctgacacgactgatgatctccccttcccggtcggcccctgcaggcatctccctccacatcggcaccggcagcatcctggaaatggacaggatgctcacctgcaagacagccactggctctgtcccttccccaggggagacatcgccaaaaggcggtatctcgggaactgttcaaagttgccagctcccaacgcccggagggtgtgaagaccgggatgacgacagagactggaaaagaagcagcgcccggggaaggggcccgatcgccggccaaaggaccggccaggccgagccccacggaccgttactccggcctccgccgggggccggggcgcagacgggcccggcgccgccaaacgcgcaccgtgcggcgcgtcccaacgcggggaggaggggagacagccgcggagaaagggctaaactgaaagcgccaaccggggcggggggctccagccggccgggctttaaggggatgtctcggccttggagaaagggagagaaaggaggggagcgcccacgtgcccggggaaggcggttgtgtccaagcgccacctgccgtcggcctgggggctcggcgggctccccgcgcccctcgggggagcagcagcagcagcgcccacccccaccccccggcccgaccgccgaccctcgcccccgcccccgcccgctcgggctgtgcgcgtgcccgggcgtgcgcccgcggggagggagcgcgcctggccggctcacccggaccggcctccagggtgggcgggtggtgggggactgggcacaaaggggcgccgggcccctccccggacccggtgcgctcggttcgctccgacgctgggactggcccagttcggccctcccgcggggacgggcgcggctcccgagcttgggagagagccctcaactttttgcagaaggagcgcgcgcgcctgggagttgcgtggggtccggcgctcgcggcgagagccaggagccggaaagaaagagagagagggggtccccgggctgctccgaccaccgtcgccgccgccgccgccgcctcctctcgcgtcgcgggccgcagctgccccgcgcgcgggcggctccgagtcgccgcagccgctgtgtgcagactggaagggggggagggggggagggggggagccgcggacgcggggtgcccaggactttgcaacttgcccgggaaggtggagggccgagcgggggagggggagccccgcacgagaccgagcggcccgggtgggagcgcccagccccgccgcggatcaagatcccgttcatccgggaggcggagcggctgcggctcaagcacatggccgactaccccgactacaagtaccggccccggaaaaagcccaagatggacccgtcggccaagcccagcgcgggccagagcccggagaagagcgcggcgggcggcggcggcgggagcgcgggcgcgggcgcgggcggcggcgccaagacctccaagggctcgagcaagaaatgcggcaagctcaaggcgcccgcggccccggcggccggcggcgccaaggcgggcgcgggcaaggcggcgcagcccggggacggcggcggcgcgggcgacgactacgtgctgggcagcctgcgcgtgagcggcgcgggtaagacggtcaagtgcgtattcctggacgacgacgaggacgaagaggacgacgaggacgagctgcagctgcggatcaagcaggaggcggacgaggacgacgacgagccgccgccgcacgcgcagctcctgcagccgccgggccagcagccgccgcccccgccgctgctgagacgctacagcgtcgcgaaagtgcccgccagccccacgctgagcagcgcggccgagtcccccgagggcgcgagcctgtacgacgaggtgcgggccggcgcggcctcgggcgcggggggcggcagccgcctctactacagcttcaagaacatcaccaagcagcacccgccgccgctggcgcagcccgcgctgtcgcccgcgtccgcgcgctccgtgtccacctcctcttcgtcctcctcgtccggcggcgcggcggcgagggacgccgacgacctgatgttcgacctgagcttgaatttctcccaaagcgcgcacggtgccggcgaccaacagctggggggcggcgcggcggccgggaacctgtccctgtcgctggtggataaggatttggattcgttcagcgagggcagcctgggctcccacttcgagttccccgactactgcacgcccgagctgagcgagatgatcgcgggggactggctggaggcgaacttctccgacctggtgttcacgtattga

SEQ ID NO: 154 - DNA, 7497 bp, Mus musculus
aactttttgcagaagaagcgcgcgcgcctgggagtgcttggggtccggcgcttgcggcggctgccaggagtgagagagcgagaaatcaagcgagtgagagagagagcgcgggtcccgggccgccgccgcctcctctccggtcgccgccgcagccgccgacgcagcagggaacggggccgggggggaggggggcagccgcggacgcgcgcggccaaggactttgcaacttgccggagaaggtggaggggcgggagggggaggggcgcccgcgcagagaccgagcgcccagcccccgccgcggaccatggtgcagcaggccgagagctcggaagccgagagcaacctgccccgggacgcgctggacaccgaggagggcgagttcatggcgtgcagcccggtggccctggacgagagcgacccggactggtgcaagacggcgtcgggccacatcaaacggcccatgaacgccttcatggtgtggtccaagatcgagcgcaggaagatcatggagcagtcgcccgacatgcacaacgccgagatctccaagaggctgggcaagcgctggaagatgctgaaggacagcgagaagatcccgttcatcagggaggcggagcgcctgcgcctcaagcacatggctgattatcccgactacaagtaccggccgcgcaaaaagcccaagacggacccagcggccaagcccagcgcgggccagagccccgacaagagcgcggcgggcgccaaggcagccaagggccccggcaagaagtgcgccaagctcaaggcgcctgcgggcaaggcgggcgcgggcaaggcggcgcagccgggggactgcgccgcgggcaaggcagccaagtgcgtcttcctggacgacgacgatgaagacgacgacgaagatgacgagctgcagctacggcccaagccggacgctgacgacgacgacgacgagcccgcgcactcgcacctgctgccgccgccgacgcagcagcaaccccctcagctgctgaggcgctacagcgtggccaaggtccccgccagccccacgctcagcagtgccgccgagtcccccgagggcgcgagcctgtacgacgaagtgcgcgcgggcggccggctctactacagcttcaagaacatcaccaagcagcagcctccgcccgcgcctcccgcgctgtcgcccgcgtcctcccgctgcgtgtccacctcctcatccagcggcagcagcagcggcagcggcgccgaggatgcagacgacctcatgttcgacctgagcttgaatttctcccagggcgcgcacagcgcctgcgagcagccactgggcgcgggagcggcggggaacctgtccctgtcgctggtggataaggacctggattccttcagtgagggcagcctgggttcccacttcgagttccccgactactgcacgccggagctgagcgagatgatcgcgggggactggctggaggcgaacttctccgacctggtgttcacgtattgagaggcgcagggctcctcgggaggcagtcgtggcggtcaggataaagaggatggtggggggagggggagaagatgctcatggtcagagagatgtggcgctgagaaattggaaacggtgatgaaatgttgttggagttaaagtgaaatgagtagttttaaacagattttccaagttttttttttaatttttatttttaaaaaattttttggtctccccactcttcccgtcctttatcgtgtctcaaggtagttgcacacctagtctggagttgtgattttttccccacccgtaaaaaaacgtgttttgtaatttctatttctttttcctgaaattcgtgattgcaacaaaggcagaggggaccgggcgggggaggggaggaggccccgctccggaaggcgctgtttgaagcttgtggctctttgaagtctgaaagacatcggcagaggaccctttagacggcacaactgttactctagggagttgatttttttttcttaagagatttaaaaaggaactggtgatttaaaaaaagaaaaacacaaaaagggaccattgcaacctttttattttattttcttttttggagggagaaagctgatgtcttctatgcatccgatttcttaaactgcagggagcttgaaaaaatgcagtctgtacaaacgcttacaaaaatcataactgtgaactgacttaagaccagagtttacttttcagatcaaattgtttatggttttacaaatgtgatttctacttggcaacctttttttggtaactcgttcccttatacctccttgattgaataccttacagcctagacctcagtacaaaaaggtattgaaacatttttgatacataacagacctcaatcttttttaaaaattaatatattttcaggcgtatttttgtacagtgaaaagggaacaatcttgctgtgttttttcagtaagactttcaggcacttcttcccttttgatttctttttctttttttctcttcttgtttttgtttttcttttttgtttgtttttttagcatgcaaatatgttggtacgttatgtcctggtttaaaaggattaaaaatttaaaagtaatccttgcatctaaaggccttgtggtttaaaaaaaaaagcaaacttttttgtacagctatagtagagatttgttcaatatttgtaggtaaagatttattgaaaatggtgacctagacctcagagctgttcttagtttaagactgtatgtactgtatcatagtaggacctatgtatctcatcgctgtgatgtgtggacggggccccagacagaaggtttgaaactggatacgcgatttttatcaaaaagaaaaaggaaaggcacatagtttaaaattttctcattttgtgcaatataattaaataaacagaccattgcatatttagtagcaaatggtggcgaagcagactcaatgcactgtcgaagtcaccgccggggtttttgggtttttttgtgtgtgctgaagtctgtgtcttgattttaataaatcagcaggatcggatagaagctcgcatggcccttagtctctcccgggagccgcgtgttcaccgcgcagcggacgcgggtggcggagggcggatgccgctttttggagcccttaggctgccataggttgcagcccggtgtcctcccttctcaccccgccctgcgtctccatccccgccgtgggcttcgcgctggtccgtgcctggcgagtctggagctagtgtccacagggctaggcctccgcttctggctttgggttttttctgttgttgttggtttttttttttttttttaaatctccacccccatccgcgggcggcatcgctgcgcgcgcgcgcgcgcgctcaatgagatacgagtggagagggccgcgcccttcagcgttatccacgcgggtggggcacgaggaaagcaaatgcgcctagagccgccttcacggtgcaggatggctttggtttctttgatggagcatttgcctccaggggcccggtccagccctcccctcccccactgccccctcccccccgccagcttgtccctcgtggtgtcccgcgcgcaagcccaactccccagggccgcgacgcacgcgaccgaggagcccttcagcagtgaattgaaactcggtgcccaacagcccgactctagacccacagaaaccattacggcgcgggcgctgaccgcggggacttgaccagtagggatccaggtcggtgccccacgcaagacaggcactgcagatagagagctcgccctcacggagcagcgcgatctcatagcgcgtgggtggggcggcgacccggtgtggctttttcgggcttccctcgcccacccctcccccacagcgccctgctgtgagccacgcggggacctttaagccgcgaataatttcaccagcggtttactggggacagattctgaagcctaaggaaaaggcattctgagtgtcttgagttcttaacatttgcatgtgttcccgtttcccgtcgggcgttttccatggtgaggaaggaacttttaaataaattagaaaaggagtgaggatctggcttcagaatggaagcatagctgcaatttgtattttaaaattatgtggccgagtttcttggtaggaaaagaagagacagttcttggttggagatcaggaaaaaaagaaatcttttctttctttctttttttttttttttttttttttttaaatcccagttagaactcaggaaaggcgcttgaatgcgcttttaacaatatttaaagcggtttcgacgaatgcattgtgaagaccattcccagtgaactctattgaatgtctaatacacaaggtattccagctactggccaggcttcaataaaaggttagctgcattttttttcctcctaagtaagtcttatttttaactgagcattgacagtatcttaaaatggtaacgtgggcgtgggcgttgtgtgcatagcagtctagccggttgggtaccctgctcctgtacctagttcacagactcgagtgcatttttttttggcgagatttccatctttgaagaaacaaaaaaacaaaaacacctgaaccagcgttctcttattctttaagctgtggaaataatttccagtttctacattctcgatatgcatccttattaaaaagataatacgaatgaaaggcagtgtgcttaaagtgtgctttgcaaatacatgttatgaatgactacggtcactgggcaaattatttgtagaatgattagcctttagctagaaaaaaaaaatcattgcagctcttttgggcctggatggttctttttaatgttaatggaggggaagtgatttaaatatgcatgctcttagcagtcaggatctgacttagttgttttgagagaaaaaaaaatcaaaaggcaaggtctactttttttctctgggaattgaaaccacaatcatcttgatactagaacagtgtaagaaatgaacatttgttcttcacttcagaattcaaatgagttttgcccaaggaatctgggaaataaggcaaataagttgctcaattttcaagtagtcattcaatagaaatatactccatcactcggctttcttattctctgatggggtattctgtatagtctcactgttttctcctaatgggcatatgtatctttgtggacacttggaagagaggttttcttgtactctctcatttctagaatctttatactctttttcctgcaaggttctctgcttttaacagatttctgaggcaactatatttgtgcttttttcttatgtaggaagaccagcgaaactagcttactgagttgtcgattttatcagtagataaagaaactttgtttattacagtttcagggaaggtttttcaggatatttctcagttattctaagggccaaattttatatataaaaaaaaaaaaacttcattaggaatgtcagtttcagataccctttgtatagcctgtggcctgcaagcacgacaggactgagccttacatgtgtccgaacaggaattcataagtccccaaagtaaacgtctccatgtaacgattcttgacgtgtttctctgagagttggcttattttgattatcaattctttctcactgtccattcctattgatttatcctgccatatctctttgggtttgatgagctcaacattttttgctctttgataacaactcaggttttggtttggggtttttcatgccccctttgtgtgttgcttatgttttccaccacagtataaaagtactgaagccaagccacttcccattcattcctttactgctgcctccctttccccaactcccaactcctaacacaccttcatttttttcccatcgtcttcttcttcttctttttttttaacactacctagatgcgttagctgcctgattagtttatctattccatgtggatgcagtgagtttataagagaatttcacaaacaagtagttttttagtgaacttaaacagaattttaaaggagacctatttttatactcaataaaagcacaaaacgtgcataaaatatagcatggcgtacaaagggaaatccactcataacgttccatgtatagaagtaataattttcttggatagcgatattctttgaagacccagtgcctgtctgcctgtgcccagacagggtggtttccacacactgggaacttccggttgccggcacttgacaaacacagttcaccacagccacaaagagcaataggtaggagctgaggtgtgcctcctgatgagcagtcggccactaggcaacctggatgtgcccatgtggaggctccagcctcactgtttgatcaaacttcttttatgtagtctcttctgtgaaaaaaaaaaaaaaaaagaccaaacaaagcaataggacaagtttgaaaatgcatttgaacataggatttcctccagggtcctcaaagagattttaaaaaaaaaaacaacaacaaaaaaaaacgtgacacttaagtttagtaggcacattacattcccctccccttcaaaaacagaacgactggaaataatcaagacatagcgtaaaaagaattttgatcaaatggatattgacaaagggccctcgatcccatttctcttcacccagcttgtgttcaaaaaccttatgcctcgtcccctgaatcacacagggagaagcgtcctatgccattgtcatggactccccactttgtctacttttgctcttgtacatatgttgtgggtatcagttgttcccatttgttctgtaacacccttgtttgaatggactgttttgaaacggaggcctgtgtctcaggtatgggacacctagtggtcgtggcaacccatcccgtgatgctttgtttcccgggacagagccacctgaagtctgagagtagttatcagcatggcactgttaacaagtgttctgttttccaaggccgagaaaaaaagaaaaagaaaaaaggaaaaaaaaaaaaaagcaactttcacagctgctccaggtttgggagaggaatagctggaaagcccttttgtttagaagtctgagtgggttatggggggacttttatagagtttgcatgccagcgcaggacctgttgctgtcagacagagagaaggagaagctacctgaggcagtgcgctgggggactacgtaagtgtcccgtagcactagggcagcaaatgcatggtgaagtcatgtcttctggtagaggttatctagcatgcagagtgtagtgtgttgaaactgtatgacgttgctgtatcaaagttgtaaaattaagcattatttattgaaaactatgtatttttttgtaaaaacctgatcacacaagagagtatcagtggcttgtgctttgtgcttcaatcaaaccagcttcgtgaccgccctccttggaatgcagtgttaatgctcagggttgaattcatacactccaatgtctctttttgcaggagtttttcacagaggaatacatttgttcaaaagaccaataaaaatcgtgtgatcaatctcc

SEQ ID NO: 155 - DNA, 2036 bp, Rattus norvegicus
gacttttttgcagaagaagggcgcgcgcctgggagtgctttggggtcccggcgcttgcggcggctgccaggagttggagagcgagaaattaaagcgattgagagagagagcgcgcgcggttccgggcccgccgccgcttcttttccggtcgccgcagccgccgccgcagcagggaacgggaccgggggggaggggggcagccgcggacccgcggggccaaggactttgcaacttgccggagaaggtggaggggcgggagggggaggggcgcccgcgcaggagaccgagcgcccagccccgccgcggaccatggtgcagcaggccgagagctcggaagccgagagcaacctgccccgggacgcgctggacaccgaggagggcgagttcatggcgtgcagcccggtggccctggatgagagcgacccggactggtgcaagacggcgtcgggccacatcaaacggcccatgaacgccttcatggtgtggtccaagatcgagcgcaggaagatcatggagcagtcgcccgacatgcataacgccgagatctccaagaggctgggcaagcgttggaagatgctgaaggacagcgagaagatcccgttcatccgggaggcggagcgcctgcgcctcaagcacatggctgattatcccgactacaagtaccggccgcgcaaaaagcccaagacggacccagccgccaagcccagcgcgggccagagcccggacaagagcgcggcgggcgctaaggcagccaagggcccgggcaagaagtgcgccaagctcaaggcgcctgcgggcaaggcgggcgcaggcaaggcggcgcagcctggggactgcggcgcgggcaaggcagccaagtgcgtcttcctggacgacgatgatgaagaggacgacgaggacgacgagctgcagctacggcccaagccggacgcagacgacgacgacgacgagcccgcgcactcgcacctgctgccgccaccggcgcagcagcagccccctcagctgctgaggcgctacagcgtggccaaggtgcccgccagccccacgctcagcagtgccgccgagtcccccgagggcgcgagcctttacgacgaagtgcgcgcgggcggccggctctactacagcttcaagaacatcaccaagcagcagcctccgcccgcgcctcccgcgctgtcgcccgcgtcctcgcgctgcgtgtccacctcctcatccagcggcagcagcagcggcagcggcgccgaggatgccgacgacctcatgttcgacctgagcttgaatttctcccagggcgcgcacagcgcctgcgagcagccactgggcgcgggagcggcggggaacctgtccctgtcgctggtggataaggacctggattccttcagcgagggcagcctgggctcccacttcgagttccccgactactgcacgccggagctgagcgagatgatcgcgggggactggctggaggcgaacttctccgacctggtgttcacgtattgaggggcacagggctcctcgggaggcagtcgtggcggtcaggataaagaggatggtggggggagggggagaagatgctcatggtcagagatgtggcgcagagaaattggaaacggtgatgaaatgttggagttaaagtgaaatgagtagttttaaacagattttccaggtttttttttttaatcttttaatttttaaaaaaattttttggtctccccactcttcccttcctttatcgtgtctcaaggtagttgcacacctagtctggattgtgatttcccccacccgtaaaaaaatcgtgttttgtaatttctatttctttttcctgaaattcgtgattgcaacaaaggcggaggggaccgggcgggggaggggaggaggccccgctccggaaggcgctgtttgaagctcgtggctctttgaagtctgaaagacgtcggcagaggaccctttagacggcacaactgttactctagggagttgatatttttttttcttaagagatttaaaaaggaactggtgatttaaaaaaaaaaaaaaaa

SEQ ID NO: 156 - DNA, 7730 bp, Homo sapiens
gtcggctgacgtggagggccggaggtggcggcggcggcggcggcggctgctgctgctgctgcccgcgtccgaggctcgcgggcggcgggcccggacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaa

SEQ ID NO: 157 - DNA, 9021 bp, Homo sapiens
cctaaagaaaagtattaagtaaatagcagtacagatggcaaatggattgcacaatatatcctctggatccatagtgaccctgcagagataaacctgtgatggtcaaacaatgtgaaaactgctgtcagagacatgggcagggtgctcttgtttacagagaagaggtgcaaaaatcaacttgatggtagtgggaagatcaggaaatgcttcctgaaattgagtattaagaactaatagacattaggtggttgcagaataagttttgtttaggaaggacaagcagttgggtatgactggcttctaggttgtgtgttgtggagtgactggggataaaagcaggagcaagatcacaaaaggtcttctatgcttatattagggaagttggactttattctcaagctgaagggaagctgttgcatggttttaagcagtaaagtgatatgatcagagttttagaggatgccaagattgaaggcaagtctgaccagttaggagactgcttgttaaattagttcagaggagaaacagtgaaggcagtggcactgggcatgaagaagtatatgtgtgctaattttagatttcttagggaagcagaaatgacaagagttagtggtccattggacagaaatattgaaggagactggggagtctaggttgactcccagggtttaggtttgggcagtaaaatgacatgtagaacaattaactgataaacagcatacagaaagaggaaagaacttcatttcatatgtttgtttttgaggaaaagatgtttgtttttgaacttcctgattcagaggggcttgtgggacatcttggttaagatcctgtagtagttctagtagggtctagaagtcaagagatacaaccccgcctggaaggatttgggagtcttcagcatttggaattttggaagccattgtttactgcagtgcatatgagataatttaaactggtacatagataaacacttgaaaaaattttaatagataggaatttaatgtgtatgagaaacataacttgcacatctaacctttgataatcatggacattatcacttaggccaagtgagctcaataaaagggaaatattaactaaaaatatatgtgatacatggaaatggcaaaaatcacggtgaagctatgcaaacgatgcaagttcagaaagtgctgtgttaagtcatgggtgtggtggataaattcacccaaggagagagtaagagtgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcaccatggacaattttgctgagggagatttcactgtggcggattatgccttgttagaagattgccctcacgtggatgattgtgtctttgctgctgaatttatgagcaatgattatgttcgtgtgactcagctttactgtgatggggtgggtgtgcaatataaagattatatccaaagtgagaggaatttggaatttgacatctgcagtatatggtgtagtaaaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcaatttgcttgaagaacttaaaactcaaagttgtatggattgtatagaggaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggtggcggatgaggcgttgaaggtagatgattgtgactgtcatcctgaattttcaccaccatcaagtcagcctccaaaacataaaggaaaacaaaaatctcgaaacaatgaatcagaaaagttcagttctagttcaccattgactttaccagcagatttgaagaacatcttggagaaacagttttctaaatcttccagagctgcacaccaggattttgctaatataatgaaaatgctgagaagcttaattcaagatggctatatggccttattggagcagcgttgccgcagcgctgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtgaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatggacagccgctgtactgtgttaaggaaacaagatagtggtgaagcaccgtttagttcaaccaaggtgaaaaacaaaagcaagaaaaagaagccaaaggattcaaagcctatgttagttgggtctggaacaacttcagtaacttcaaataatgagatcatcacttcaagtgaagaccatagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacaaggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtatataaagaaagggaaagaggattatgaagagagtcatcagagagctgtggctgcagaggtatccgtacttgaaaactggaaggagagtgaagtgtataagctacagatcatggagtcacaagcagaagcctttctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaaaaaaaaaaaaaaaa

SEQ ID NO: 158 - DNA, 7710 bp, Pan troglodytes
ggagggggcggtggcggcggcggcggcggcggctgctgctgctgcccgcgtccgaggctcgcgggcggcgggcccggacttgtgcaccatggacaattttgctgagggagatttcactgtggcggattatgccttgttagaagattgccctcatgtggatgattgtgtctttgctgctgaatttatgaccaatgattatgttcgtgtgactcagctttactgtgatggggtgggtgtgcaatataaagattatatccaaagtgagaggaatttagaatttgacatctgcagtatatggtgtagtagaccaatttctgtcctgcaagattattgcgatgccattaaaataaacatcttctggccacttctgtttcaacatcaaaacagttccgtaatatcacgattgcatccctgtgtggacgccaacaattcacgtgcttctgagataaatttgaagaaactacaacatcttgagttgatggaagatattgtggatttggcaaagaaagttgctaatgattcattccttattggaggcttattgagaattggttgtaaaatagaaaataaaatcttggcaatggaagaagctctgaattggataaaatatgcaggcgatgtaacaattctaactaaattaggatcaattgacaattgttggcctatgttaagtattttctttactgaatacaagtaccacataactaaaattgtaatggaagactgcagtttgcttgaagaacttaaaactcaaagttgtatggattgtatagagcaaggagaactaatgaaaatgaaaggaaatgaagagttttccaaagaaagatttgatatagctattatctattacaccagagccattgaatatagacctgaaaactaccttctttatggtaaccgagctctttgttttcttcgtactggacagtttagaaatgcactcggtgatggaaagagagccactattctgaagaacacttggccaaagggtcattatcgttattgtgatgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcgaacagcaaataaggatccaattaaagccttttatgaaaacagggcctacacacctaggagtttatcagcacctatatttactacttcacttaactttgtggagaaggaaagagatttcagaaaaattaatcacgaaatggccaacggtggtaatcagaatctaaaggcggcggatgaggcgttgaaggtagatgattgtgactgtcatcctgaattttcaccaccatcaagtcagcctccaaaacataaaggaaaacaaaaatctcgaaacaatgaatcagagaagttcagttctagttcaccattgactttaccagcagatttgaagaacatcttggagaaacagttttctaaatcttccagagctgaacaccaggattttgctaatataatgaaaatgctgagaagcttaattcaagatggctatatggccttattggagcagcgttgccgcagcgccgcacaggcctttacagagttgctgaacggtttagatcctcaaaaaataaagcaattgaacctggccatgattaactatgttttggtcgtctatggacttgccatttctctccttggaataggacagcctgaggaattatctgaagccgaaaaccagtttaagaggattattgaacactaccccagtgagggccttgattgcttggcctactgtggaattggaaaagtatatttgaaaaaaaacagatttctagaagctctcaatcactttgagaaagcaagaaccttgatttatcgtcttcctggagtgttaacttggcccacgagtaatgtgattattgaagagtctcagccacaaaaaataaagatgctgttagagaaatttgttgaagaatgcaagttccctccagtgccagatgccatttgttgctatcagaagtgccatggatattctaagatccagatatacataactgatccagactttaagggttttatacgcatcagctgttgccagtactgtaaaatagaatttcacatgaattgctggaagaagttaaaaactacaacctttaatgataaaattgacaaggattttctacaaggaatatgtcttacccctgactgtgaaggtgtcatttctaagattatcatcttcagcagtggtggtcaagttaaatgtgaatttgaacacaaggtcataaaagaaaaggttcctccaagacctattctgaaacagaaatgttctagcctagagaaactaagactgaaagaagacaaaaaattgaagagaaagatccaaaaaaaagaagcaaaaaagttggcacaagaaagaatggaggaggacttaagagaaagtaatcgacccaaaaatgaagagcagaaagaaactgtagacaatgttcagtgttttcagttccttgatgacagaattctacagtgtataaagcagtatgctgacaagattaaatccggcatacagaatacagccacgcttctcaaagaattgctttcttggaaagttttgagcacagaagactatacaacctgtttttctagcagaaattttctaagtgaagcagtggactatgttattcgtcacttgattcaagaaaataacagagtaaagacaagaatatttctgcatgttttgagtgagcttaaagaagtggagcccaaattagccgcctggatccaaaaacttaatagctttggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctactagaagaacacagagacaagttcccagcattgcatagtgctttagatgaattctttgatataatggacagccgctgtacggtgttaaggaaacaagatagtggtgaagcaccgtttagttcaaccaaggtgaaaaacaaaagcaagaaaaagaagccaaaggattcaaagcctatgttagttgggtctggaacaacttcagtaactccaaataatgagatcatcacttcaagtgaagaccatagcaatcgaaattcagattctgcaggcccatttgcagtgcctgaccatcttcggcaagatgtagaagaatttgaagctctctatgaccaacacagtaacgaatatgttgtccgcaataagaagctatgggacatgaacccaaaacaaaaatgttcaactctgtatgattacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttctgaagatgtgaaacccaaacctgtgtctgcaaattctcccaagccagcttgtgaagatgtgaagtccaaaccggtatccgacaattcttctagacaagtttctgaggatgggcaacccaaaggggtctcttctaattctcccaaaccaggctctgaggatgcaaattacaggcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggctagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtatcttggaacataatacaccaagaagtcaatactgagccatataatccttttgaggaacgacagggggaaatttcacggattgaaaaggagcaccaagtattacaagaccaacttcaacaagtgtatgaaaattatgagcagataaaacttaagggcttagaagagaccagggacctggaagagaagttgaaaaggcacttagaagaaaacaagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtatacccagaaaaatgatggaaaggaaaaggaacatgaattacatctggatcagtcccttgaaatcagcaacacacttacaaatgagaaaatgaaaatagaagagtgtataaagaaagggaaagaggattatgaagagagtcatcagagagctgtggctgcagaggtatccgtacttgaaaactggaaggacagtgaagtgtataagctacagatcatggagtcacaagcagaagcctatctgaagaagctggggctgattagccgtgatcctgcagcatatcctgacatggagtctgatatacgttcatgggaattgtttctttctaatgttacaaaagaaattgagaaagcaaagtctcagtttgaagaacaaattaaggcaattaaaaatggttctcggctcagtgaactttctaaagtgcagatttctgagctttcatttcctgcctgtaacacggttcatcccgagttactccctgagtcttcaggccacgatgaccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacagcactgagcttgctggttttattaaaaaagtgcgaagcaaaaacaagaactcactctcaggattgagtattgatgaaattgtccaaagagtgacagaacacattctagatgaacagaaaaagaaaaagccaaacccaggaaaggacaagaggacttatgagcccagctctgccgcccccgtgaccaggtcctcccagggctcaccctcggtggttgttgcaccatcacccaaaaccaaggggcagaaagcagaagatgtccctgtgaggattgcactgggtgcaagttcctgtgaaatatgccacgaggtgttcaaatcaaaaaacgtgcgtgtgctcaaatgtgggcacaagtatcacaaagggtgctttaagcagtggcttaaagggcagagcgcttgcccggcctgccagggtcgtgatctcctgacagaagagtcaccttctggaagaggctggcccagtcagaatcgggagctgccttcctgctcctctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgttgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttgtgtttgaaaaacctgttctggtagctccacaagagagatgatactgactttttaaattttttacaagagtctgtattcctgatgtgcctatatttttcctcaaagattctgcattttaaggatgggcataagcaaactatattttaataatgtatagttaatgttaaaatattggctgatttagaccaaaagattcaaatctcctctttgtgaaatcccatctgcatttgattttttattattttatgttcccccgatagattgttttaagtgtttgcttttcatcttttatagatgtaatctgattttcaaaaatcattaacactttttaattagtatcgactaagactttttccccctggaatcgaggctgtgtgtccatcatcccagcccccggttggagcctgctctttgaactccgctgccctcctcagcagcttctgtcctcttctgtgagtcagtcagcaagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttttgtgtttgatatttgtgtaaagtatgcatgcagtcttgtactgtggcctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaaggagaagttcactgtca

SEQ ID NO: 159 - DNA, 7320 bp, Canis lupus
atggatgattttgccctgggagatttcactatagcagatgatgctttgtcagaagattgcccttatgtggacggttgtgtctttgctcctgaatttatgtccaatgattatgttcgtgtgactcaactttactgcgatggggtgggtatgcagtataaagattttacccaaagtgagagaaacttagaatttgacatctgtaatatgtggtgtagtaaaccagtttctgtcctgcaagattattgtgatgccattaaaatatacatcttctggccacttctgtttcaacgtcagcatagttctataatatcacggttacacccctgtgtggaggccaccaactctcatgcttctgagataagtttgaagaaattgcaacatctagaattgatggaagatattgtggatttggcaaagaaagtcgtgaatgattcattctttattgggggcttattgaggattggttataaaatagaaaataaaatcttggcaatggaagaagctttgaattgggtgaaatatacaggcgatgtaacaattctacctaaattaggagcagttgacaattgttggcctatgttaagtattttctttactgaatacaagtatcacataactaaagttgtaacagaaaactgcaatttgcttgaagaatttaaaactcaaaattgtgcggaatgtatagagcaaggagaactaatgaaaatgaaaggaaatgaagagttttcaaaagaaagatttgatatagctattatctattacaccagagccattgaatatagacctgaaaatcaccttctttatggtaaccgagctctttgttttcttcgcactggacagtttagaaatgcacttggtgatggaaagagagccactatcctgaagagcaattggacgaagggtcattatcgttattgtgctgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctgcaaggtcgaacaccaactagaaatccaattaaagccttttatgaaagcagggcctacatacctagtttatcagcacctgcatttagtacttcacttaactttgtggaaactgaaaaagattccagaaaaactaaccgcgaaatggcaaacggtggtaatcagaatctaaaggtggtagatgaagctttgaaggtagatgattgtgactgtcatcctgaatttctaccaccatcaggtcagactccaaaatacaaaggaaaacaaaaatctcgaaacaatgaattggagaagttcagttctagttcacaggggagtttaccagtagatttgaagaacattttggaaaaacaattctctaaatcttccagagctgcacatcaggattttgctaatataatgaaaatgctgagaagcttaatccaggatggttacacggctttgttggagcagcgttgccgcagtgctgcacaggccttcacagaattgctcaatggtttagatcctcaaaaaataaagcaattgaacctggccatgattaactatgtcttagtagtctacggacttgctatttctctccttggaataggacagcctgaggaattatctgaagctgaaaaccagtttaagaggatgattgaacactaccccaatgagggacttgattgtttggcctactgtggaattggaaaagtatatttgaaaaagaacagatttctagaagctcttaatcattttgagaaagcaagaaccttgatttgtcgtcttcctggagtgttaacttggcccacaagtaatgtgattattgaagagactcagccggggaaaataaagatgctgttagagaagtttattgaagaatgcaggttccctccagtgccagatgccatttgttgctatcagaagtgccgtggatattccaaaatccagatatatataactgatccagactttaagggttttatacgaatcagctgctgccagtactgtaaaatagaatttcacatgaactgttggaaaaagttgaaaacaacaacttttaatgataaaattgacaaggattttctacaaggaatttgtcttacccctgactgtgaaggaatcatttctaagattatcattttcagcagtggtggtcaagttaaatgtgaatttgaacacaaggtcataaaagaaaaggttcctccaagacctattctgaaacagaaatgttctagcctagagaagctaagactgaaagaagacaaaaaattgaagagaaagatccaaaaaaaagaagcaaaaaaattagcacaagaaagaatggaagaggacctaagggaaagtaatccacccaaaactgaagagcagaaagaaactgtagacagtgttcagagttgccagttccttgacgacagaattctgcagtgcataaagcagtacgctgacaagataaaatctggtattctgaacacttccaagcttctcaaagaattgctttcttggaaggttttaagcacagaagactacacaacctgtttttctagcagaaattttctaaatgaagcggtggactacgtcattcgtcacttgattcaagaaaagaatagagtaaagactaggatatttctgcatgttttgagcgaacttaaagaagtggagccaaaattagccgcttggatccagaaacttaacagctttggtttagatgccacaggaccttttttttctcgttatggagcctctcttaaggagcttgattttagcatcatgacttttctctggaatgagaaatatggtcataaactagcctctatagaaggaaagcaacttgattatttctgtgagccaacatcagtgaaggaagcacggtgtttaatatggctgctagaagagcatagagacaagttcccagcgctacacaatgctctagatgagttctttgacataatggatagccgctgtactgtattaaggaaacaagacagtggcgatgtgccgtttaattccgccaagataaaaaataaaggcaagaaaaagaagccaaaagattcaaagcctatgttggtggggtctgggacaccttctgtaacaccaaataatgagactatcacttcgggtgaagaacataacagacgcaattcaaattctgcagggccatttgtggtacctgaccaccttcggcaagatgtagaagaatttgaagctatctatgagcagcacagtagtgaatatgttgtccgtaataaaaagctgtgggacattaacccaaaacaaaaatgttcaactctgtatgattatttctctcagttgttggaggagcatggtcccttggacatgagtaataaaatgttctctgaagaatatgaattcttcccagaagaaactagacagatactagaaaaagctggaggtttgaaatctttcctcctgggatgtcctcgttttgttgtgattgacaactgtattgctttgaagaaagttgctttacggctcaagaaaaagagaaagaagaaaaacattaagacaaaagtggaagaaatttcaaaaacaggggagtatttacgagttaaactaccactgaatccaactgctagggaatttaaaccagatgtaaagtccaaaccaatgtctgatttatcttcagcaacagcttctgagaatgtgaagcccaaacctgtagctgctaattctcccaaatcaacctgtgaagttatgaagccaagaccagtgtctgataattcttctagatcagtttctgaagatgagaagcccaaagaagtctcttctgattctgcccaacctgtatctgaggatgcaagtcacaagcgagtatcctctaattctcctaaaccagcttctgaggatgtgaaaccagcctactggactcagccccatttggtcacaggatactgtacatacctcccctttcggggatttgacattacccagacaccaccaacatacataaatgtgttaccaactttgccccagtacactaacatttacacacctctgcccaatgtttcttctgaatatcagctgcaaagatcagtgccagtggtgccgtcttttatacccagtgaaagactagatgaaagtgctactgtgtactttgagggtcatcatttgaatgctgagaatgcccctgggaaccagattgtccctaaaacacagatccttcaggactctatggaagtgtcagtaaagacagagtgcagcacagatggtgctgatacagcccttagtgagtctaacagatatgatggtcactgtggaaattctgccaacaagtgggaagtaaatccagaaaaaaacaatgaagtaacaaatactccacatacacaaatggttgccatacaggtgtcttggaatataacacatcaagaagtcaatactgagccatatgatccttttgagacacaacagggagatatttcacagattgagaaggagttccaggttttacaagagcagcttaacgaggcatgtgaaaattatgagcagagaaaactcaagggctcagaagagaccagggatctggaagaaaaattgaaaaggaacttagaagaaaacaagatctcaaagacagaattagattggttccttgaagacttggaaaaggaaatcaagaaatggcaacaggagaaaaaagaaatccaagaaagtctgaaagcgctaacaaagaaaatgagaaaggttttaaatgccaacgagatatatgcccagaaaaatgatggaaaggaaaaggaacatgaattacttctggatcagtcccttgaaatcagtaatacgtttacaaatgagaaaatgaaagtagaagaatgtataaagaaagggaaggagaattatgaagagagtcttcaaagagctgtggctgcagaggtatctgtgcttgaaaactggaaggacattgaagtgtacaaattacagatcatggaatcacaagcagaagggtatcttaagaacctgaggctactgagcagtgattctgcaacttaccctgataaggaatctgatatacattcatgggaatcatttctttctaaggttaaaaaagaaattgaaaaagcaaagtctcagtatgaagaacaaattcaagcaattaaaaatggctctcgactcagtgaactttctaaagtgcaagttcctgagctttcatttcctgtctgtagcacaattcttcctacatcacttcctgagtcttcaggccatgaagatcacagagcctccatttctacaagtcatgaggctggaaaccaaacagcagttcctaaggactcaagtctggtctctgccagtgacggcccagtgggggcttcctctccaccattgacaggatcgctctcctgtcagcccgaagtcacccagctgccagagtgtaagagcacaggccaggaaactccgccaaaacaaagccttgtggctgatcagaaactacctgttcttccaggacgtgctacccgctcaagccagtctccaaaaaagccgttcaacagtattattgagcacctgtcagtggtattcccatgttacaacagcactgagcttgctggttttattaaaaaagtgcgaaacaagaacaaaaactcgctctcaggattgagtattgatgaaattgtccaaagagtgacagaacacattctagatgaacagaaaaagaaaaagccaaattcaaattcagcaaaggacaagaggttgtctgagcccagctccactgcttctgtgaacagggcctcccagggtccaccctccgtgactgctggaccatcgcccaaaaccaagggacaaaagacagaagatgcccctgcatcgggtgcagcttcctgtgaactgtgccatgagatattcaaatccaaaaacgtgcgtgtactaaaatgtgggcacaagtttcacaaagggtgctttaagcagtggctgaaggggcagagcacttgcccggcctgcctcgatcaggatctcctgtaagaagagtagcggcaccttctggaagaggccagcctgcttttctaggtagtcacaggttcactggagagtaatttactggtttgttggattggaagaataacaattatattacttctggtataaaaggcaaacatttgaagattctttgcactgtgtgtcacagcgctaataaatggagatctttaatacagttgatagtaatttccctgctcttattaaacacttcgataatagcaaatagtggctaataaaattatgtgtaaccacatccctaaattgttgaggctgcttacagagatgctttctgagatggaaggcttcttttgaaagtattgtgagcacctcaaagcagtacttcaattgtaagtattctgatctcttacagtgccccaggttaaaatttttacaagtcagtattccttaaaatatgcctacatttttcttcaaagattctgcatttaaatgggtttaagcaaacacattttaataatctgtactaaagggtaacatactgactgatataaaccaaaagattcaaatcttctttttagaaaataccatgtgatttttgctttttcatttcattattttattccccccagtagatttatagagagcttattttttatcacctaaaatattatttgatttttgaaaatcaattacaaatactttattagtgtcagccaagacctttttttgccttgaaaattgaggctacatatttatcacccgaatcctacatttggaattctttctttgaatatcatactcttattaggagcatttgtccctcttcatgagagatgactaatgttggggtgtctctaacacatagtgggcaccatagggagaaacattcaccatcattcccctccctatcctgacaccaggaagaggcacttgtgtagacaatcttgaggtgtccttgtttcactggttccgtgtttgacatttgtgtgaagtaatgcatgcactcttgtactgtggtgtgagaacaaaactaactgcattagaatctgttaaaatattagatatctttagtgacttgtagactgtggcaaatatagaaacatgaattctgaacacattccatagtctctcagacatcaaaaaatgtttttcatcgtgttctttgttcccctggaagttcacagtcccaagttcgtgagttaatttggttgccttcctcagccttggttccttgtgagttttgatgtcttagtgacttagtccataggatgctcactctgtattttgaagcagattctccttgcaggtccctgaaacattgtctacatgttcataataactgag

SEQ ID NO: 160 - DNA, 7368 bp, Bos taurus
atggccgattttccccagggaaattttgcagattatgccttgttagaagattgcccttatgtggatgattgtatctttgcccctgagtttatgtccagtgattatgttcgtgtgactcagctttactgtgatggagtgggtagacagtataaagattatgcccaaactgagggaaacttagaatttgacatctgcactctgtggtgtagtcaacctatttctgtcctgcaagattactgtgatgccattaaagtccacatcttctggccacttctgtttcaacgtcagcagagctctataataacacggatgcactcctgtgtaaggaccagcggttctcatgcttgtgagataagtttgaagaaattacagcagcttgaactgatggaagatattgtggatttggcaaagaaagttgtgaatgatacattctttatcggaggcttattgagaattggctataaaatagagaataaaatcttggcaatggaagaagctttgaattgggtgaaatacacaggcgatgtaacaattttatctaaattaggagcagttgataattgttggcgtatgttaagtattttctttactgaatacaagtatcacataactaaagttgtaacagaaaactgcagtttgcttgaagaatttaaaactcaaagttgtgcggagtgtctagagcaaggagaactaatgaaaatgaaaggaaatgaagagttttccaaagaaagatatgatatagctattatctattacaccagagccattgaatgtaggcctgaaaatcacctgctttatggtaaccgagctctttgttttcttcgtactggacaattcagaaatgcacttggtgatggaaagagagctaccattctgaagaacaattggacaaagggtcattatcgttattgtgctgctctttctatgctgggggaatatgactgggccctgcaagcaaacataaaagctcaaaaactctgtaaaaatgaccctgagggaatcaaggatctaattcagcagcatgtaaagttacaaaaacaaatagaagacctgcaaggtcaaacaccagctagtaatccagtcaaagccttctgtgaaagcagggcctacatacctagtttatcagcacctgcatttagtacttcacttaactttgtggaaactgaaaaaaatttcagaaaaactaaccacgaaatggcaaacggtggtaatcagaatccaaaggtggtagatgaagctctgaaagtagatgattgtgactgtcatcctgaatttgtaccgccatcaagtcagcctccaaaatataaagggaaacaaaaatctcgaaacaatgaattggagaagttcagccctggttcacaagaaactttaccagtagatttaaaaaacatcttggagaaacagttttctaaatcttccagagccgcacaccaggattttgctaatataatgaaaatgctgagaagtttaattcaggatggctacacggccttgctggagcagcgctgccgcagcgccgcccaagccttcacagagttgctcaacggtttagatcctcaaaaaataaagcaattaaacctggccatgattaactacgtgttagtagtctacggacttgccatttcactccttggaataggacagcccgaggagttatctgaagctgaaaaccagttcaagaggatgattgaacactaccccaatgaggggcttgattgcttggcctactgtggaattggaaaagtgtatttgaaaaaaaacagatttttagaagctcttaatcattttgagaaagcaagaaccttgatctgccgtcttcctggagtgttaacttggcccacaagtaatgtggttattgaggagactcagccagggaagataaagatgctgttagagaaatttgttgaagaatgcaggttccctccagtgccggatgccacttgttgctatcagaagtgccatggatattccaaaatccagatatatataactgatccagactttaagggttttatacggatcagctgttgccagtattgtaaaatagaatttcacatgaactgctggaagaagttaaaaacaacaaccttcaatgataaaattgacaaggattttctgcaaggaatctgtcttactcctgattgtgaaggaatcatttcaaagattatcatcttcagcagtggtggtcaagttaaatgtgaatttgaacacaaggtcattaaagaaaaggttcctccaagacctattctgaaacagaaatgttctagcctagagaagttgaggctgaaagaagacaaaaaattgaagcgaaagctccaaaaaaaggaagcaaaaaaattagcacaagaaagactggaagaggacttaagggaaagtaacccaccaaaaactgaagagcagagagaaactatcaaccatgtccaaagttgccagttccttgatgacagaattctgcagtgcataaagcagtacgctgacaagattaagtccgggatactgaatacttccaagcttctcaaagaattgctttcttggaaggttttaaccacagaagactacacaacgtgtttttctagcagaaatttcctgaatgaagcagtggactatgtcattcgtcatttgatccaagaaaagaatagagtaaagacaagggtatttctgcatgttttgagtgagcttaaagaagtggacccaaaactagccacctggatccagaaactgaatagctttggcttagatgccacaggacctttcttttctcgttatggggctcctcttaaggagcttgattttagcatcatgacttttctctggaatgagaaatacggtcataagctaggctctatagaaggaaagcaacttgattatttctatgagcctacatcactgaaggaagcgcggtgtttaatatggctgctagaagaacacagagacaagttcccagcactgcataatgccttggacgagttctttgatataatggacagccgctgcactgtattaaggaaacaggacagtggtgacgtgccatttaattctaccaagataaaaaacaaaggcaagaaaaagaagccaaaagattcaaagcctatgttagttggatctggaacaccttcagtcacaccaaacaatgagactgtcacttcaggtgaagaccatatcaaacgcagtttaaattctgcgggcccctttgtagtgcctgatcaccttcggcaggatatagaagaatttgaagctctgtatgaacagcatagtaatgagtatgttgtccgtaataagaagctgtgggacataaacccaaaacagaaatgttcaactctatacgattatttctctcagttgttggaggaacatggtcccttggacatgagtaacaaaatgttttctgaagaatatgagttcttcccagaagaaactcaacagatactagaaaaagcaggaggcttgaaagcgtttctcctgggatgtcctcgttttgttgtgattgataactgtatcgcattgaagaaagttgcattacggctcaagaaaaagagaaagaagaaaaacattaaaacaaaagtagaagaaatttcaaaaacaggagagtatttacgagttaaactaccactgaatccaactgctagggaatttaaaccagatgtaaagtccaaaccagtgtctgacttaccttcagcaccagcttctgaggacatgaagcctcagcctgcacctgctaattctccccaatcagctcgtgacactgggaagccaaaaccagttttcgataattcttccagatcagtttctgaggatgagaagcccaaagggatgtcttctgattctcccaggccagtctttgaggataccggtcacaagccggtctcctctaattctcccaaaccagttcctgaggaagtgaaagcgacctattggcctcgaccccagttggtcacaggatactgtacatatcttccctttcggggatttgacattacccagactccaccagccttcatcagtgtgttaccgactttgccccagtatagcatttacacccctctggccagtgttcctactgagtatcacctgcaaagaccaataccagtggtgccgtcttttgtagccagtgacataacggaagtgcattttgaggctcatcatttcagtgctgagaatgcccctggtacccagattgcctccgaaacacagatccttgaggaatctttggaaacaccagtgaagtcagagtgcagctatgatggtgctgatatagtccagagtgaggctagcagaaacgatgactactgtggcgattctgccaaatgggaagtaaatccagaaagcaccaatgaagtaacaaatattccatgtacacaagtggttgctgtacaggtgtcttggaatataacacatcaggaagtcaatactgagccatatggtccttttgaggcacaacaggggggtatttcacaggttgaaaaggagtaccaggttttacaagagcagcttaaggaagcatgtgaaaattatgaacacagcaatgtcaagggctcagaagaaaccaaggacttggaagaaaagttgaaaaggaatgttgaagaaaataagatctcaaagacagaactagattggttccttgaagatttgaacaaggaaattaaaaaatgggaacaggagaaaaaagaaatccaagaaagactaaaggcactgaagaagaaaatgaaaaaggtgttaaatgccagcaaaatgtatacgcaggaaaatgatggaaaggaaaaggcacttgaattacttctggatcagtcccttgaaatcagtaatacatttacaaatgagaaaatgaaaatagaagagagtataaagaaagggaaagagcattatgaagagagtcttcaaagggctgtggatgcagaggtatctgtgcttgaaaactggaaggacatggaagtgtgtaagttacagagcatggagtcacaagccgaaaggtttctcaagaatctgaagctaatgagcagtgattcggcagcgtattctgacatggactcagacatacattcatgggaatcgtttctttctgatgttagagaagaaattgagaaagcaaagtctcagtttgaagaacaaattcaggcaattaaatatggttctcagctcagtgaacttcctaaagtgcagatttctgagctttcatttcctacctgtaacacgattcatcctaaattacttcctgagtcttcaggccaggatggtcaaggtccctccacttctacaagtcatgggaccggagaccagacagcagctcccgaggagtcaagtctgggctctgcagctgacagcccagtggagttgccctcctgcagtcagaaagccccccagctgccagagcatgagggtgctggccaggcaactgggccagaaccaggcccagtggctgatcagaagttacctgctgctccagagcgtgccactcattcaagccagtctccaaagaagccgttcaatagcattattgagcacctgttggtggtgttcccgtgttacagcagcacggagcttgctggttttattaaaaaagttagaaacaaaaacaagacctctctgtctggattgagtattgacgaaattgtgcaaagagtgacagaacacgtccttgatgaagaaagaaagaaaaagccaagtccaggaaagggctggaggctgtctgcacccagctctgctgttgctgtgcccagggctgcccaggacccgccctccatgcctgtcggagcatcgcccgaaaccagggggccgaggaccgaggacgtccctgtgtcctgcgcaaattcctgtgaaatgtgccgagaagtattcaagtccaaacacgtgcgtgagctgcagtgtgggcacaggcttcacaaggggtgcttcaagcagtggctgaagagccagcgcacctgcccagcctgcctgggtcacgacctcctgtcagaggagtagctgccttgctggaggaggcccgcctgctattctcggcagctacagttcacgctggagatatgctgcttgttgagttggaagactagcagtgtactccctttagtatcaaaagcagacacctgaagcttctttgcactctgtgttgcagtgctaataaatggaactctttaatacagctgagagtaagtaatttcccaactcttgactagatatatagtaatcgccaagtggtggctgataaaatcacgtgtaaccgcttccttctgttgttggggctgctgcagaggcgcgctctgagatggaaggaaaagactgtgagtgtgtcaaagcagaactcgattatcagcatccttggcctgctaaagtgcccccgggaaaaggtttttgagattggtattcctgaacttatgcctacattttccctcagagattctgtgttttaaaaaatgagcttaagcagactaccttttaataggttgtaatgttaatattggctgatttcagaccagaagattcaagtctcctattcatgtgatttttcatttcattattttttctccccagtagatttgtaagtgcttgttttccatctttcaaagacacaatgatttttgaaaatcagttacaaaacccttgctaacatcagccaagacttcttaacccctgaagtcgaggctccctcatcatcatcccacccccgggtctggagcagactgttttgaataccttagtgttctcgttagtgacctttgtctgcctctctgagttagacaacaagcgtttgggtatctgtctggcacacagcggcagctgagggaaacagtcaccatcattccctttccttaccccaccaccaaaaagagacacttgtataattagacagtcctgagatgttgctgttccagtcgttcgtgtttgacattgtgtagagtaatgcatgcactcatgtactgtagcctgagaacaaaaccgcagctgcgttagacaaactgcttctcttcagtgacttacagacagcagtagacatagaaccgtgaattacgggcgccttccatctctctcaaactagaaggatcaaaaagtgttttcccacgcgttctctgtttccctcagaagttcagagccccaggttcacgcgctgacgcagtcgcctccgtctgctttgcttctccctcggttttgacgtcttagtgcatagacgctcattccatattttgaagcaggtcccgaaaacattgtctgcatgttcagaataactgaggacttgcagatacgaaggtatacaggcgcagcgggaaaggagaacagctggagagtgagaggatgtgttcatggcataacctcaaactgttaacttgtgaacatgccttccacgtgtcctgtgtcgaaataaagagcgttctaaaataa

SEQ ID NO: 161 - DNA, 7295 bp, Mus musculus
accctaagccacgtgacccgcccgcctcaggagccgcggagcgttcgctctgcgggtctggttgacgtggagggccggaggcgtcggcagcccgcgtctgaggctcgcgggctgcgggcccgggactgtgcagcatggatgactttgctgagggaggtctcagtttggcagatgatatcttactggaagattacccttatgaggatgactgtatctgtactcctgactttaccactgacgattatgttcgagtaacccagctttactatgaaggcgtgggtatgcaatataaagattatgcccaaagtgagaaaaatttagaatatgacatctgcaatatctggtgcagtaagccactctccatcctgcaagattactgtgatgccattaagctgtacatcttctggccacttctttttcaacatcaacacagttctataatatcaagattgcacccctgtgtagaagccatccgttctcgtgctgctgagataagtttgaagaaattacaacatcttgagttgatggaagacattgtggatttggcaaagaaagttgcaaatgattcattccttattgaaggcttattgaaaattggttataaaatagaaaataaaatcttggcaatggaagatgctttaaattggataaaatacacgggtgatgtaacaattctacctaaattaggatcagttgacaattgctggcccatgctaagtattttctttactgaatataagtaccatattactagagttgtaactgaaaattgcaacttgctagaagaatttagaaggcatagttgcatgcagtgtgtgaagcaaggagaactcatgaaaatgagaggaaatgaagagttctcaaaggaaaagtttgaaatagctgttatttattacaccagagccattgaatatagacctgaaaaccatcttctttatggtaaccgagctctctgttttcttcgtatggggcagtttagaaatgcacttagcgatggaaagagggccattgttttgaagaacacctggccaaagggtcattatcgttattgtgatgctctttgtatgctgggggaatatgactgggccctgcaagcaaacataaaagctcaaaaactctgtaaaaatgaccctgagggaatcaaggatctaattcagcagcatgtaaagttacaaaaacaaatagaagacctacaaggtcggacatcaaataagaatccaattaaagctttttatgaaagcagggcttacatacctagaaactcatcagcacctgcttttaggacatcacttaactttgtggaaacagaaagaggtttcagaaaaactaagtacaaaatggcaaatggtggcgatcagaatcaaaaggtggcagatgaggctttgaagggggacgattgtgactgtcatcctgaatttctgccacctccaagtcagcctccaagacacaaaggaaaacaaaaatcacgaaacaatgaatcagaaaagcccagttctaattcagaagtgagtttacaagtagatttgaaaagcattttggagaaacagttttcaaaatcttccagagctgcacaccaggattttgctaacatcatgaaaatgctaaggagcttgattcaggatgggtacacggccctgttagagcagcgctgccgcagcgctgcccaggcctttacagagctgctcaatggtttagaccctcagaaaataaagcaattgaacctggccatgattaattatgtattagtagtctatggacttgccgtttctctccttggaataggacgaccagaggagctgtctgaagccgaaaaccagtttaagaggattatcgaacactatcccaatgaggggctggactgcttggcctactgcggaataggaaaagtgtatttgaaaaagaacagatttctcgaagctcttaatcactttgaaaaggcaaagactttaattagtcgtctccctggaattctaacttggcccacaagtaatgtgattattgaagaatctaagccagaaaaagtcaaggtgatgttagagaagtttgttgaagaatgcaagtttcccccagtgccagatgctgtttgttgctatcagaagtgccgtggatattctaaaattcagatttacttaactgatccagactttaagggttttatacgaattagctgttgccaatactgtaaggtagaatttcatatgaactgctggaaaaagttaaaaacaacaacttttaatgataaaattgacaaggattttctacaaggaatctgtctcactcccgattgtgagggaatcatttctaagattatcatctacagcagtggaggtcaagttaaatgtgaatttgaacacaaggtcataaaagaaaaggttccttcaagacctgttctgaaacagaaatgttccagcctagagaagttaagactgaaagaagacaaaaaattgaagagaaagatccaaaagcaagaggcaaaaaagttagcacaagaaagaatggaagaggacttaagagaaagcaatccacctaaaaatgaagagccagaagaaacctcagacagtgctcagcgttgtcagtttcttgatgacagaatcctgcagtgcataaagcagaatgctgacaagattaaatctgttgtattgaatacatccacgcttctcaaagagctgctctcttggaaggttctgagcacggaagactatacaacatgcttttctagcaaaaattttgtccatgaagcagtggactatgttatcggtcacttgatccaagagaagaacagagtaaagacacggatatttctgcatgttttgagtgagcttaaagagttagaccccaagttggctccctggatccagagactgaatagttttggcttggatgccataggaccctttttcactcggtacggagcatctctcaaggagcttgatttccacgtcgtgactgtcctctgggatgagaagtacggccataaactgggctctatagaaggaaagcagcttgattacttctttgagccagcatcggcaatggaagcacgctgtttaatatggcttctggaagagcacagggacaagtttccggccttgcacagtgccttagacgagttctttgatataatggacagccgatgcactgtactaaggaagcaagacagcgatgaaatgccgtttggttgtatcaaggtaaaaaacaaaggcaagaaaaagaagccaaaagattcaaagccaatgttagtgggatctggagctgcatcagtagcaccgagcagtgaggctgtcactccagaagaccatagcaggcgcaattcagattctgcaggaccatttgcagtgcctgaccaccttcggcaagatgtggaagaatttgaagctctttatgaccagcacagcagcgagtatgttgtccgaaataagaagctctgggatattaaccccaaacagaaatgttcgactctgtatgattatttctctcagttgttggaagagcacggccccttggatatgagtgacaggatgttctctgaggaatatgagttcttccctgaagaaactcgacagatactggagaaggcaggagggctgaagtcgttcctcctgggctgtcctcgatttgttgtgatcgacaactgcattgcattgaaaaaagttgcctcaagactcaagaaaaaaagaaagaagaaaaacatgaaagctaaagttgaagacatttcaaaaacaggagaatatttacgagttaaactaccactaaatccaactgctagggaatttcaaccagatgtaaagtctgaagcactgtctgaggatgtgaagtccataccaggacctgccgactcctcaaccctagctgcggaggatctgaaggcccagctggactctgatagctcttctgggtcagcttcggaggacagcagactggaagtggcctctcctgactctcctacaccactctgtgaggatgcttctccttcccccacgccagctcctgaagaagccaaaccaacatactgggctcaatcacacttggtcacaggattctgcacataccttccttttcaaggatttggcatcacccagcgaccagcgtacattaacatggtacctagcctgtcgcagttcactagcatttacacacctttggccaacatttcttctgagtatccaatgcaaagatccatgccagtggtgccatcttttgtagccagcaacagagcagatgaaaatgccgctgcatactttgagagtcctaatctgaatactgagcacgactctggtgaccacatggcctctgaaacacagatcctggaggatactttgggagtgtgtgtcaggtcccagggcagcgcagctgatgctgatccagctctgagtgagcctgagggaaacagcgaacacagtgggagctctgacagcctgtgggaagcttctctagaaaatgtcagtggaacaacagatgctccagctgctccatcggttgccatacaggtgtctaggagcatggtacatcaggaagtcaacactgagccgtatgagccgtttgaaacacagcagggggacctttcccagaaggaaaaggagtgccacctactcagagagcagctgaaggtagcatgtgagaactgcgagcagatagaactcaggagctcacaagagatcaaggacctggaggaaaagctgcaacggcacacagaggaaaacaagatctcaaagacggaattagactggttcctccaagatttggacagagagattaaaaagtggcaacaagagaaaaaagaaatccaagaaagattaaaagccctgaagaaaaaaattaaaaaggttatcaataccagtgaaatgcctgcccagaaaaatgatggattcgataaggaatgtgaaccacatccggaccagtcccttggattcagcagtgcactcacagatgagaagacaaaagtagaagagtctgtcaggaaagggaaagagctctatgaagagagtcaccagagagccgtggctgcagaggtatctgttcttgaaaactggaaagagcgagaagtgtgcaaactacagggtgtggcgtcacaatcagaagcctatcttaaaagcctcaagctgatgagcagtgattctgcaacgtatcccgatgtggagtatgatatactttcatgggagtcatttctttctactgtaagagaagagatcgagagcaaaaagtctcagtttgaagagcatattaaggccattaagaatggttctcgactcagtgacctttccagtgtgcagctttctgaggtttcatttcctggttgttcgacgatccatcctcagttcctctctgagtcttcaggccatgaggatcccggactggtggcttgtgtagacagcatgactggagcagtcctcaatgatccttacatggactctgctagtggctgcccagaggaggttccagaactgtcgctgggatcacccacccatcagccagaagttactcaacagcttgagctcaagggggctagccaggtgtctccatcagaacagagccctgaggccgacgagaaactatctggacaggctactcggtcaagccagtctccaaaaaagccttccaacagtattattgaacacctgtcagtgatattcccatgttataccagcactgagcttgctgggtttattaagaaagttagaaacaaaaccaagaactcattctcgggattaactattgaggagattgtggagaaagtgacagaacacattgtcgatgagcaaaagaagaaaaagccaaatccaggaaaagacaagaagacatctgaggctcattcggctgcctctgtggccaagtcctcccagagtccacccttggcagctgctggaccatcagctagaaccaaaggccagaaaaaagatgatgtccctgcaccagatggaaattcctgtgagatatgccatgaaatattcaagtcaaaaaacatgcgtgtgctaaaatgtgggcacaagtttcacaaagggtgctttaagcagtggctgaaagggcagagcacgtgccccacctgtggcagcagtgacctgctgtcagaagagtaactgttgcaccatcgtcacagacccagcccaggagaagatgggaacctccttcctgttgctgtaggtagtcactcctcactaatgcaccatgcacttcatgagttaaagaacaacagtgtcctgttaccagtgtaaaaacagcaaacatggaagctctcacactgtgcatcacaaagctaacaaatggaaatctgaattgcagtctgtcccaggttccaggcaggtgacagccatgtgtgtctgcaatgctgtcaccatggtcctgcactgtcgtggctgctgcaggatactctgagatgagcaggttctttggaaagaactgctgagctcctcaaagcagtgctgagattgtaaaggctctcagcctcctcagttcctcatgtggcactgtagcatccccgtcataaatttttaaagtgcttatgattcaattaatctacattttggtaatcaattataaaatactttttaaattagtattggctattttttttttttaccctgggaagatgctgtctgctcacaggagtcccacacttggcacttacactaaggttaccatgtaagtctcatgagtcagcagtgcttggaagtgcacagctggctagtgctgaaaacaggacatagtgcccagcgcagggcagccaccctcaccctccttccttatccttccaccagaagagaaatgtaccacagtcctgatgtgttggtgttaacattgttctgtttgacttttgtgtaaagtaatgcatgcaatcttgtaatgtggcctgaaaacaagctaactgtattagaaactattcaaaaactaggtatttttagtgacctgtaggcagtggcaaatacagacatgtgaaccttgaatacattacatttctctcaaacacaaagaaacaaacaaaaaacttttccagcgtgttctctgctgccctggagatgccgtcaccttccacccgtgtctgtgtgagttgtggtgtcttagtgacttagtatgtagctcactccttattctgagacattgtctgtggtgtccctgaaacatggtgtccatgctgtaacagtggagtgcagtacatgcctgagtacacacagcagcttatagtatctgtcgggtacaaagaagagtagctgttgagacagagagctgtgcttcgtgtcagagcctgtgaacatgccttacacttgtccagtaactgtcaataaagaacattataaaaggtc

SEQ ID NO: 162 - DNA, 7364 bp, Rattus norvegicus
gcccgcctcaggagcggctcagcgctcgctctgcgggtctggttgacgtggagggccggaggcgtcggcagcccgcgtccgaggctcgcgggctgcgggcccgggtgagtgcagaccctgcgcgcggcggggctcccggaagcgtctgcgcatcccgccgcagccgagatgcctgggcatcggggcgctccacacctccctccgtgggtgtgtggactgtgcagcatggatgactttgctgagggaggtctcagtttggcagatgatatcttactggaagattacccttatgaggatgactgtatctgtactcctgactttaccactgatgattatgttcgagtaacccagctttactatgaaggcgtgggtatgcaatataaagattatgcccaaagtgagaaaaatttagagtatgacatctgcaatatatggtgcagtaagccactgtccatcctgcaagattactgtgatgccattaagctgtacatcttctggccacttctctttcaacatcagcacagttctataatatcaagattgcacccctgtgtagaagccatccgttctcgtgctgctgagataagtttgaagaaattacaacatcttgagttgatggaagacattgtggatttggcaaagaaagttgcaaatgattcattccttattgaaggcttattgaaaattggttataaaatagaaaataaaatcttggcaatggaagatgctttaaattggataaaatacacgggtgatgtaacaattctacctaaattaggatcagttgacagtggctggcccatgttaagtattttctttactgaatataagtaccatattactagagttgtaactgaaaattgcaacttgctagaagaatttagaaggcatagttgcatgcagtgtgtgaagcaaggagaactcatgaaaatgagaggaaatgaagagtttgcaaaggaaaagtttgaaatagctgttatttattacaccagagccattgaatatagacctgaaaaccatcttctttatggtaaccgagctctctgttttcttcgtatggggcagtttagaaatgcacttagtgatggaaagagggccattgttttgaagaacacctggccgaagggtcattatcgttattgtgatgctctttctatgctgggggaatatgactgggccctgcaagcaaacataaaagctcaaaaactctgtaaaaatgaccctgagggaatcaaggatctaattcagcagcatataaagttacaaaaacaaatagaagacctacaaggtcggacatcaaataggaatccaattaaagctttttatgaaagcagggcttacatacctagaaactcatcagcacctgcttttagaacatcacttaactttgtggaaacagaaagaggtttcaggaaaactaagtacagaatggcaaatggcggtggccatcagaatcaaaaggtggcagatgaggctttgaagggggacgattgtgactgtcatcctgaatttctgccacctccaagtcagcctccaagacataaaggaaaacaaaagtcacggaacaatgaatcagaaaagcccagttctaattctcaagtgactttacaagtagatttgaaaagcattttggagaaacaattttcaaaatcttccagagctgcacaccaggattttgctaacatcatgaaaatgttaagaagcttgattcaggatgggtacacggccttgttggagcagcgctgccgcagtgctgcccaggcctttacagagttactcaatggcttagatcctcagaaaataaagcaattgaacctggccatgattaattatgtattagtagtctatggacttgctgtttctctccttggaataggacgacctgaggaactgtctgaagccgaaaaccagtttaagaggatcatcgaacactatcccaatgaggggcttgactgcttggcctactgtggaataggaaaagtatatttgaaaaaaaacagatttctcgaagctcttaatcactttgaaaaagcaaaaactttaatttgtcgtctccctggaattctaacttggcccacaagtaatgtgattattgaagaatctaagccagaaaaggtcaaggtgatgttagagaagtttgttgaagaatgcaagtttcctcctgtgccggatgctgtttgttgctatcagaagtgccgtgggttttccaaaatccagatttacctaactgacccagacttcaagggttttatacgaattagctgttgccaatactgtaaagtagaatttcacatgaactgctggaaaaagttaaaaacaacaacttttaatgataaaattgacaaggattttctacaaggaatttgtctcacccctgactgtgaaggaatcatttctaagattatcatctttagcagtggtggccaagttaaatgtgaatttgaacacaaggtcgtaaaagaaaaggctccttcaagacctgttctgaaacagaaatgttctagtctagagaagttaagactgaaagaagacaaaaaattgaagagaaagatccaaaaacaagaggcaaaaaagttggcacaagaaagaatggaagaggacttaagagaaagtaatccacctaaacctgaagagccggaagaaactgtagaaagcgctcagagttgtcagtttcttgatgacagaatccttcagtgcataaagcagaatgctgacaagattaaatctgttgtgttgaacacttccacgcttctcaaagagttgctgtcttggaaggttctgagcacagaagactacacaacatgtttttctagcaaaaattttgttcatgaagcagtggactatgttatcggtcacttgattcaagaaaagaacagagtaaagacacggatatttctgcatgttttgagtgagcttaaagagttagaccccaagttagctccctggatccagagactgaatagctttggcttagatgccacaggacccttttttactcgctatggagcatctctcaaagagcttgattttaacattgtgactttcctttggagtgagaaatatggccataaactaggttctatagaaggaaagcaacttgattacttctgtgagccagcatcagtaatggaagcacgctgcttaatatggctgctggaagagcacagggacaagttccccgccttgcacagtgctttagacgagttctttgatataatggacagccgatgcactgtgctaaggaagcaagacagtgatgaaatgccgtttggttgtatcaaggtaaaaaacaaaggcaagaaaaagaagccaaaagattcaaagccgatgttagtgggatctggaacagcatcagtaacaccaagtagtgagactgtcactccagaagaccataacaggcgcaattcagattctgcaggaccatttgcagtgcctgaccaccttcggcaagatgtggaagagttcgaagctctttacgaccagcacagcagcgagtatgttgtccgaaataagaagctgtgggatattaaccccaaacagaaatgttcaactctgtatgattacttctctcagttgctggaagagcacggccccttggatatgagtgataggatgttctctgaggaatatgagttcttccctgaagaaactcgccagatactggagaaggcaggagggctgaagtcgttcctcctgggctgtcctcgatttgttgtgattgacaactgcattgcattgaaaaaagttgcctcaagactcaagaaaaaaagaaagaagaaaaacattaaaactaaagttgaagaaatttcaaaaacaggagaatatttacgagttaaacttccactaaatccaactgctagggaatttcagccagatgtaaagtctgaagcagcagctgaggatgtgacgtccataccaggacctgctgactcttcagcaccagctgctgaggatctgaagccccagctggactctgatagctcttctgggtcagcttcagaggacagcagactggaagttgtctctcctgacttgcctacaccactctgtgaggatgcttctccttcccccacaccagctcctgaagatgccaaaccaacttactggactcagtcacacctggtcacaggattctgcacataccttccttttcaaggatttggcatcgcccagtctcggccagcgtacattaacatggtaccaagcctgtcccagttcactagcatttacacgcctttggccaacatttcttctgagtatccaatgccaagatccatgccagtggtaccatcttttgtagccagcgagagagcagacggaaatgccgctgcatactttgagagtcatcgtctgaacactgagaacgcctctgatgaccacactgcctctgaaacacagatcctggagggtcctttgggaatgtgcgtaaagtcccagagcagcacagctgatgcccggacagctctgagtgagcctgaaggaaacagcagacacagtgggagctctgacagcctgtgggaagcttctctagaaaacgtcagtggaataacagatgttccaccagctccgtcggttgccatacaggtgtccaggagcttgatacatcaggaagtcaatactgagccatatgcaccttttgaaagacaacagggggacctttcccagaaggagaaggagtgccacctgctcagagagcagcttcaggtggcctgtgaggagtgtgagcagatggaactcaggagctcacaggagaccagggacctggaggagaagctgcaaaggcacgcggaggagaacaagatttcaaagacggaattagactggttcctccaagatttggacagagagattaaaaagtggcatcaagagaaaaaagaaatccaagaaaggttaaaagccctgaagaaaaaaattaaaaaggttatcaataccagtgacatgtctgcacagaaaaatgatggattagataaagaatgtgaatcacagccggaccagtcccttggaatcagcagtgcactcacagatgagaaggcaaaagtagaggagtctgtcaggaaagggaaggagctctatgaagagagtcagcagagagctgtggctgcagaggtgtctgtgcttgagaactggaaggagcgagaagtctgtaaactgcagggcgtggcaacacaagcagaagcctgtcttaaaagcctgaagctgatgaacagtgactctgcagcatatcctgatgtggagtgtgatatactttcgtgggaaacattcctttctactgtaacagaagaaattgagaacacaaagtgtcagtttgaagagcaaattaaggctattaagagtggctctcgactcagtgacctttccagtgtacaggtttctgagcttttatttcctgcttgttcaatgattcatcctcagttactctctgagtcttcaagacatgaggatcacgggctagtggcttgtgtagacagcatgactggagcagtcctcaacgatccgtatgtagggcctgatagtggctgctcagaggaagttccagaactgtcactgggatcgcctacccatcatccagaaggtgctcaacagttagaggttaagaaggctagccaggtgtctccatcagaacagaaccctgaggctgatgaaaaaccatctgggcaggccacgaggtcaagccagtctcaaaaaaatcctttcaacagtattattgaacacctgtcagtgatattcccatgttatgccagctccgagctttctggttttattaaaaaagttagaaacaaaagcaagaactcattctcgggattaagtattgaggagattgttgagagagtaacagaacacattgtcgaggaacagaagaagaagaagccaaatccaggaaaggacaagaagacatctgaggctcatcccgctgcctctgtgtccaagtcttccccgagtccacccttggcagctgctggaccatcagctaaaaccaaaggccagaaaaaagatgatgtccctgcaccagatggaaattcctgtcaaatatgccatgaaatattcaagtcaaaaaacatgcgtgtgctaaaatgtgggcacaagtttcacaaagggtgctttaagcaatggctgaaagggcagagcacgtgccccacctgtggcagcagtgacctgctgtcagaagagtaacctgttgcgccaccatcacagtcccagcccagaagaagatgggaccctccttcctgttgctgtaggtagtcactcctcactaatgcaccatgcacttcatgagttaaagaacaacaatgtcctgttgccagtgtaaagacagcaaacatggacactctcgcactgtgcatcacaaagctaacaaatcgaaatcttgaatgcagtctgtcctaagtccaggcaagtgacagccatgtgtgtctgcagtgctgtgtcaccacgtcctgcattgttggagctgctgcagggacactgagatgagcaggttctttggaaagaactgttgtgctcctcaaagcagtgttcagattttaaaggttcttagcctcctcagttccttatgtggaactgtaggatccccttcataaatttttaaagtgcttatgtgatccaattggtctacattttggtaatcaagtataaaatactttttaaattagtatcagctaagaattttttttaccctgggaagatgctgtctgttcacaggagtcccacacttgacacttacactaaggttaccatgtaagtctcatgagtcagccagtgcttggaaaggcccggctgaatgcaggacaaagtgccgagcacaggacagtcactctcactctccttccttattcttcctccggaagggaaatgtactacagtcctgacgtgttggtgttaacattgttctgtttgacttttgtgtaaagtaatgcatgcaatcttgtaatgtggcctgaaaaacaagctaactgtattagaaactattcaaaaactaggtattttttagtgacctgtaggcagtggcaaatacagacacgtgaacccaagatacattacatttctttcaaacacaaagaaacaaaaatgtttcccaacgtgttctctgctgccctggagatgctgtcaccttcgacctgtgtccatgtgatttgtggtgtcttagtgacctagtctgtagcttactctttattctgagacactgtccctggtgtacgtgctgtaacagtgaatgcaggccatgctaaagtgcgcgcacagcagcttatggtacccgtcgggcacagaggcgtagctattgagacagtgagctgtgcttcacgtcagcctgtgaacatgccttacacttgtccagtacctgtcaataaagagcattctcaaagatc

SEQ ID NO: 163 - DNA, 1922 bp, Mus musculus
ctcagcccgtagcccgtcggttccggagtaagttccaggtggcccagcagtgggtgtggaaggggaggatcatcagacccactgacacagacccaagacagcaagaagctaaccaggcaccatgcgagagatcgtgcacattcaggcgggccagtgcggcaaccagatcggtgccaagttttgggaggtcatcagtgatgagcatggtatagaccccactggaagttaccatggagacagtgatttgcaactggaaagaatcaatgtatactacaatgaagcaactggtaataaatatgtgcctagggccatcctggtggacctggagccaggcacaatggactcagtcaggtctggaccatttgggcagatcttcaggccggacaacttcgtgttcggccagagtggtgcaggaaataactgggcaaagggccactacacagagggggccgagctggtggactctgtcctggacgtggtgaggaaggagtcagaaagctgtgactgtcttcagggcttccagctgacccactcactggggggaggcactggctcaggcatggggaccctgctcatcagcaagatcagagaggagtacccagaccgcatcatgaacaccttcagcgtcatgccctcacccaaggtctctgacactgtggtggagccctataatgccaccctctcagtgcaccagctggtagagaacacagatgaaacctactgcatcgataatgaggctctgtatgacatctgtttccgcaccctgaagctgaccacacccacctatggcgatctcaaccacctggtgtcagccaccatgagtggagtgaccacctgcctgcgcttcccaggccagctgaacgcagacctgcgcaagctggccgtgaacatggtgccattcccacgcctgcacttcttcatgccaggctttgcacctctgaccagccggggcagccagcagtaccgagccctgacggtgcccgagctgacccagcagatgttcgactccaagaacatgatggctgcctgcgaccctcgccatggccgctacctgaccgtggccgccattttccgtggccgcatgtccatgaaggaggtggatgagcagatgctcaacgtgcagaacaagaacagcagctacttcgtggagtggatccccaacaacgtcaagacggccgtgtgtgacatccctcctcgtggcctcaagatgtcagccaccttcattggcaacagcactgccatccaggagctgttcaagcgcatctcggagcagttcactgctatgttccggcgcaaggctttcctgcactggtacacgggtgagggcatggacgagatggagttcaccgaggcggagagcaacatgaatgacctggtgtctgagtaccagcagtaccaggatgccacggctgatgagcagggcgagttcgaggaggaagagggcgaggatgaggcttgagttccccaggccaagcaggttagggaaagctgagatgaaaggagggggtgggggggcttaatctgtgaaaataccttggcagttgaaggaaggagaatggtcttaggtttgtgctgggtctctggtgctcttcactgttgcctgtcactttttttctctttttgtaataccgataacatcaatgtaacacttgagatctttctgaactcctgttgtaatggctaaaatcacataaacctttgtgtcctaacggtgtcctcttttctttctcttcctttctccctatcaagctctttgttatcaacttaaatccacctttctgaacacagaaaattttcttcctttagaaaagactgaaagctcaggtgtttgtttcttctttgggtatgctattaatataagttgaaccaaaaatggccttactcaatccaacaatgagaagaaacaatggattttaagatgt

SEQ ID NO: 164 - DNA, 2019 bp, Homo sapiens
gggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcgtagatgcccccgcgagacgggttagggaaagcggaggaggaaagcgagggggtggggggcttcccgggacgataacctggcagtggaaggaaagaagcatggtctactttaggtgtgcgctgggtctctggtgctcttcactgttgcctgtcactttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtctacttgaaagca

SEQ ID NO: 165 - DNA, 2063 bp, Pan troglodytes
attacgtcatccgggcctggagagcgccagcgcgaaggggactggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaagttttgggaggtcatcagtgatgagcatgggattgaccccactggcagttaccatggagacagtgatttgcagctggagagaatcaatgtttactacaatgaagccactggtaacaaatatgttcctcgggccatcctcgtggatctggagccaggcacgatggattcggttaggtctggaccattcggccagatcttcagaccagacaatttcgtgtttggccagagcggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggtgaggacgaggcgtagatgcccccgcgagacgggttagggaaagctgaggaggaaagcgagggggtggggggcttcccgggacgataacctggcagtggaaggaaagaagcatggtctactttaggtgtgcgctgggtctctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattaaattcttcctttaacaaaaagcaaaggcgtaggtaaaagctcaaatgaatttattctttgggtatggtaaaattgaaccaatcacagttaagatgagagatcaacctgagttttaaaatacttttaataaatattagttgaaaaaatgtctacttgaaagcac

SEQ ID NO: 166 - DNA, 1544 bp, Canis lupus
tctccctcgccagcaccatgcgtgagatcgtgcacatccaggccggccagtgcggcaaccagatcggcgccaagttttgggaggtcatcagtgacgagcacgggatcgaccccaccggcagttaccatggagacagcgacttgcagctggagagaatcaatgtgtactacaatgaagctactggccagagcggtgccgggaacaactgggccaagggccactacacggagggcgccgagctggtagactcggtgctggacgtggtgaggaaggagtcggagagctgcgactgcctgcagggcttccagctgacgcactcgctgggcggcggcacgggctcgggcatgggcacgctgctcatcagcaagatccgcgaggagtaccccgaccgcatcatgaacaccttcagcgtcatgccctcgcccaaggtgtcggacacggtggtggagccctacaacgccaccctgtcggtgcaccagctggtggagaacaccgatgagacctactgcatcgacaacgaggccctgtacgacatctgcttccgcaccctgaagctgaccacccccacctacggcgacctcaaccacctggtgtcggccaccatgagcggcgtcaccacctgcctgcgcttcccgggccagctcaacgccgacctgcgcaagctggccgtgaacatggtgcccttcccgcgcctgcacttcttcatgcccggcttcgccccgctcaccagccgcggcagccagcagtaccgcgcgctcacggtgcccgagctcacccagcagatgttcgactccaagaacatgatggccgcgtgcgacccgcgccacggccgctacctgacggtggccgctatcttccgcggccgcatgtccatgaaggaggtggacgagcagatgctcaacgtgcagaacaagaacagcagctacttcgtcgagtggatccccaacaacgtcaagacggccgtgtgcgacatcccgccgcgcggcctgaagatgtcggccaccttcatcggcaacagcacggccatccaggagctgttcaagcgcatctcggagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacagggggagttcgaggaggaggagggcgaggacgaggcctagggaggcctgaggtccccgggtggcccagggtgccccagggcgccccagggcgcgggcctgcaggaggcaagcgcgggggaggggggcttagtgcggagaatctctgggcagtggaaggcaagaagcatggtcttctctaggtgtgtgcgctggttctctggtgctcttcactgttgcctgtcattttggtttgtttctgtttttttctttttgtaatattgaccacatcaatgtaacatttgagatatttctgaactactgttgtaatggctaaaatcacataaacgtttgtgtcctaac

SEQ ID NO: 167 - DNA, 1700 bp, Rattus norvegicus
ccggagtaagttccaggtagcccagcagtgggtgtggaaggggaggatcatcagacccactgacccagacccaaggcagcaagaagctaacgaggcaccatgcgagagatcgtgcacattcaggcgggccagtgcggcaaccagatcggtgccaagttttgggaggtcatcagtgatgagcatggtatcgatcccactggaagttaccatggagacagtgatttgcaactggaaagaatcaatgtatactacaacgaagcaactggtaataaatatgtgcctcgggccatcctggtggacctggagcctggcaccatggactctgtcagatccggaccatttgggcagatcttcaggccagacaacttcgtgttcggccagagtggtgcaggaaataactgggcaaagggccactacacagagggtgccgagctggtggactctgtcctggacgtggtaaggaaggagtcagaaagctgtgactgtctccagggcttccagctgacccactcactggggggaggcactggctcaggcatggggaccctgctcatcagcaagatcagagaagagtacccagaccgcatcatgaacaccttcagcgtcatgccctcacccaaggtctctgacactgtggtggagccctataatgccaccctctccgtgcaccagctggtagagaacacagatgaaacctactgcatcgacaatgaggctctgtatgacatctgcttccgcaccctgaagctgaccacacccacctatggcgatctcaaccacctggtgtcagccaccatgagtggagtgaccacctgcctgcgcttccctggccagctgaacgcagacctgcgcaagctggctgtgaacatggtgcctttcccacgcctgcacttcttcatgccaggcttcgcacctctgaccagcaggggcagccagcagtaccgagccctgacagtgcccgagctcacccagcagatgttcgactccaagaacatgatggctgcctgcgacccacgccatggccgctacctgaccgtagccgccattttccggggccgcatgtccatgaaggaggtggatgagcagatgctcaacgtgcagaacaagaacagcagctacttcgtggagtggatccccaacaatgtgaagacggccgtgtgtgacatccctcctcgtggcctcaagatgtcagccaccttcattggcaacagcaccgccatccaggagctgttcaagcgcatctcggagcagttcactgccatgttcaggcgcaaggctttcctgcactggtacacgggcgagggcatggacgagatggagttcaccgaggcggagagcaacatgaatgacctggtgtctgagtaccagcagtaccaggatgccacggctgatgagcagggcgagttcgaggaggaggagggcgaggatgaggcttgagttccccaggccaagcaggttagggaaagctgaggtgaaaggagggggtggggggtcttaatctgtgaaaataccttggcagttggaagaaggagaatggtcttaggtttgtgctgggtctctggtgctcttcactgttgcctgtcacttttttctctttttgtaatatcgataacatcaatgtaacacttgagatctttctgaactcctgttgtaatggctaaaatcacataaacctttgtgtcctaaaaaaaaaaaaaaaa

SEQ ID NO: 168 - DNA, 3343 bp, Mus musculus
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccatggctgagaacggcgagagcagcggccccccgcgcccctcccgcggccctgcggcggccccaggcgcggccagcccgccggccgagcccaaaatcatcaaagtcactgtgaagacccccaaagagaaggaggagttcgcggtgcccgagaacagcaccgtgcagcagttcaaggaagcgatttccaaacgcttcaaatcgcagaccgatcagctcgtgctgattttcgccggaaagatcctgaaagatcaagataccttgatgcagcatggcatccatgatggactgactgttcacctggttatcaaaagccagaaccgtccgcagggccaggccaccacgcagcccagcacgactgcgggaacgagcacgacgaccacgaccaccaccacggcggcggcgccggcggcgacgacatcatcggctcccaggagtagctccacacctaccaccacgaatagcagctcctttgggctgggaagcctttccagccttagtaacctgggcttgaactcgcccaacttcaccgagcttcagaaccagatgcagcagcagctcctggccagccctgagatgatgatccagatcatggaaaatccctttgttcagagcatgctttcgaatcctgatctgatgaggcagctcatcatggccaatccacagatgcaacaattgatccagagaaacccagaaatcagccacctactgaacaacccagatataatgaggcagacgctggaaatcgccaggaatcctgccatgatgcaagagatgatgcgaaatcaagacctggctctcagtaatctcgaaagcatcccaggtggctacaatgctctgcggcgcatgtacactgacattcaagaacctatgctgaatgccgcacaggagcagtttgggggcaacccgtttgccacggtggggagcagttccacctcaggggaaggtactcagccctcccgcacggagaatcgtgatccgctgcccaatccttgggcaccaccgccaacaacccagacggctgcgaccaccaccaccaccacgaccacaagcagtggcagtggctctggcagcagctccagcagcaccaccgccgggaacaccatggctgcagctaattacgtggctagcatcttcagcaccccaggaatgcagagcctgctgcagcagataactgagaatccccagctgattcagaatatgctgtctgcgccctacatgcggagcatgatgcagtcgctgagccagaatccagatatggcggcccagatgatgctgagtagcccgctgttcacttcgaatcctcagctgcaggagcagatgcgtccacagctcccgaatttcctgcagcagatgcagaatccagaaaccatcgcggccatgtcaaacccgagagcgatgcaagcgctaatgcagatccagcaggggctacagactctagccactgaagcacctggcctcattcccagcttcgctccaggtgtggggatgggagtgctgggaaccgccataacccctgtgggcccagtcactcccatagggcccatcggccctatagttcctttcacccccataggccccatcgggcctataggacccactggccctgcaagctcccccggctccaccggcactggcatcccgcctgcaaccactgtgtccagctctgcacctactgaaaccataagtccaacctcggaatctggacccaaccagcagttcattcaacaaatggtgcaggctctcactggaggaagccctccacagccgccgaatcctgaagtgagatttcagcagcaactggaacagctcaacgccatggggttcttaaaccgcgaagcaaacttgcaggccctaatagcaacaggaggcgacatcaacgcggccattgagaggctgctgggctctcagccatcctaattacgtttctgtaccttgaaaaaaaatgtatcttatttttgataatggctcttaaatctttaaacacacaaaattgtgctttacttttattttgattcttttaaatctgtctacctataaatctaataggatgcattttaaggtggagtccctccctccctccctccctccctccctgctcctcctccccccaccctctcccttcccttccagcctgccctctcccctctttgtttccttcattcctttcttttcttcttttgatttccttccttctctgatttgaatggtgggaatcaatactgtttcactcaaaggtgttgcatgcaaacacttctctttattctgcatttattgtgatttttggaaacaggtatcagccttcacagttgggtgaacaagttttgtcctacagatgtccagtttatttgcattttaaacattagcctatgatagtaatttaatgtagaatgaagatattaaaaaaacagaagcaaattatttgaagctctctaatttgtggtaaaatattgcttattgtgactttggcatgtatttttgctagcaaatgctgtaagatttataccattcattgatcgtttttgctatttgtacacagtacagtaagcacaattggaattgtacatctagaagtattactgtagaatctctgagcagaatatgtgtaaccaaaataagaaagaatataagaaatattcctgaagctaggtatgtctcacaattttgtagaatcttacagcatatttgataaatttctcagtgaaaatgttggctaggcaagttcagttaaaatatagtagaaatgtttatcctggtttctctaagtatacattaaattgtacagaaaccttacagtgtaacattgtgtcaacagttgcagattgattgtatatgaccttaatctttgtgcagcctgaaggatcagtgtagtgactccaggaaagtgctttttatctaagagttcctcagcttctcccatgaagagaccttcatatgcattttgatttgtaattggaaatgtaacttttactggaagtgtcatgtgatgtttgcattacttttaactgctatgtataaaggaaagtgtatcttttggctctatcagttatttctcttgtgcacagggaaaaatgcattaaaatgactaaaaaaataaaaaaataataaaaaaaaaaaaaaaaaa

SEQ ID NO: 169 - DNA, 3324 bp, Homo sapiens
cggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctgattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggtgtgggggtgggggtgctgggaaccgctataggccctgtaggcccagtcacccccataggccccataggccctatagtcccttttacccccataggccccattgggcccataggacccactggccctgcagccccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggcgacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatgaaaaaaaaaaaaaaaaaa

SEQ ID NO: 170 - DNA, 3313 bp, Pan troglodytes
  modified_base (126)..(126): a, c, t, g, unknown or other
tcatcacagaggtaccgtgctccgcgctccccgcctgacccggcccagcccgctgcggcggcgcctccttccttcctccttccctcgcgctctctctttcgcccgcccgcgccttccctgcccgcntgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccgctacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgtcggcgccctacatgagaagcatgatgcagtcgctgagccagaatccagatttggctgcacagatgatgctgaatagcccgctgtttactgcaaatcctcagctgcaggagcagatgcggccacagctcccagccttcctgcagcagatgcagaatccagacacactatcagccatgtcaaacccaagagcaatgcaggctttaatgcagatccagcaggggctacagacattagccactgaagcacctggcctgattccgagcttcactccaggccccattgggcccataggacccactggccctgcaggcccccctggctccaccggctctggtggccccacggggcctactgtgtccagcgctgcacctagtgaaaccacgagtcctacatcagaatctggacccaaccagcagttcattcagcaaatggtgcaggccctggctggagcaaatgctccacagctgccgaatccagaagtcagatttcagcaacaactggaacagctcaacgcaatggggttcttaaaccgtgaagcaaacttgcaggccctaatagcaacaggaggggacatcaatgcagccattgaaaggctgctgggctcccagccatcgtaatcacatttctgtacctggaaaaaaaatgtatcttatttttgataatggctcttaaatctttaaacacacacacaaaatcgttctttactttcattttgattcttttaaatctgtctagttgtaagtctaatatgatgcattttaagatggagtccctccctcctacttccctcactccctttctcctttgcttatttttcctaccttcccttcctcttgtctccccactccctccctctttgtttccttccttccttatttcctttagtttccttccttagccgttttgagtggtgggaatcaatgctgtttcactcaaaagtgttgcatgcaaacacttctctttattctgcatttattgtgatttttggaaacaggtatcaaccttcacagttgggtgaacaagtgttgtcctacagatgtccaatttatttgcatttttaaacattagcctatgatagtaatttaatgtagaatgaagatattaaaaacagaagcaaattatttgaagctctctaatttgtggtacgatattgcttattgtgactttggcatgtatttttgctagcaaaatgctgtaagatttataccattgatcttttttgctatatttgtatacagtacagtaagcacaattggcactgtacatctaaaaatattacagtagaatctgagtgtaatatgtgtaaccaaaatgagaaagaatacaagaaatgtttctggagctagttatgtctcacaattttgtagaatcttacagcatctttgataaacttctcagtgaaaatgttggctaggcaagttcagttaaaatatagtagaaatgtttatcctggtatctctaagtatacatttaattgtacagaaaatttacagtgtaacattgtgtcaacatttgcagattgactgtatatgaccttaatctttgtgcagcctgaaggatcagtgtagtaatgccaggaaagtgctttttacctaagacttccttctcagcttctcccataaagagaccctaatatgcattttgatttgtaattggaaatgtaactttcactgaaagtgtcatgtgatgtttgcattacttttaactgctatgtataaaggaaagtgtgtcttttgacttcatcagttatttctcttgtgcacagagaaaaatgcattaaaaatgactaaaaaaaataaaaaattaaaaaatggataaatcttttctttttgccttttggccctaggatcgtgtttaggaggattatcccaccccgagattatataaatcttatcctatatttctctaacttatatggttttatttagaaaatgttttgtcctgtctggaattatcttgatatatggatttaggtattctaacttttttgccccaaagggttagcca

SEQ ID NO: 171 - DNA, 3333 bp, Canis lupus
aggcccagagacctgaacgcagacgcttctcccgcggcctacagcgtcttctccccaccggaggaccaggaaaccgcagttctcatcacagaggtaccgtgctctgcgctccccgcccggctcagcctgctgtggtggcgcctccttccttccttcttccctcgctctctttctcgcccgcccgcgccttctctgtctgcctgcgtcaccgcggccgccatggctgagaacggcgagagtagcggccccccgcgcccctcccgcggccctgccgcggcccaaggccctgcctctgccccggccgagcccaaaatcatcaaagttactgtgaagacccccaaagagaaagaggagttcgcggtgcccgagaatagctcagtccagcagtttaaggaagcgatttcaaaacgcttcaaatcccaaaccgaccagctagtgttgatttttgccggaaaaatcttaaaagatcaagataccttgattcagcatggcatccatgatggactgactgttcatcttgtaattaaaagccagaaccgacctcagggccagtccacacagcctagtaatgccgcgggaactaatactacctccgcgtcgactcccaggagtaactccacatctgtttccacaaatagcaacccgtttgggctggggagcttaggaggacttgcaggccttagcagcctgggcttgagctcgaccaacttctctgagctccagaaccagatgcagcagcagctcctgtccagccctgagatgatgattcaaatcatggaaaatccctttgttcagagcatgctttcaaatcccgatctaatgaggcagctcattatggccaatccacagatgcagcagttgattcagagaaatccagaaatcagtcacctgctcaacaacccagatataatgagacagaccctggaaattgccaggaatccagccatgatgcaagagatgatgagaaatcaagatttggctctcagcaatcttgaaagcatcccaggtggctacaatgctctacgacgcatgtacactgatattcaagaacccatgctgaatgctgcacaagagcagtttgggggtaatccatttgcctcggtgggaagcagttccacctctggggaaggtacacaaccttcccgcacagaaaatcgagatccactacccaatccatgggcaccaccaccggctacccagagttctgcaaccaccagcacaacctccagcagtggcagtggctctggcagtagctccagcagtgctactgggaacaccgtggctgcagccaactatgttgccagcatcttcagtaccccaggaatgcagagcttgctgcaacagataactgaaaaccctcaactgatccagaatatgctgtctgcaccctacatgagaagcatgatgcagtcgctgagccagaatccagatttagctgcacagatgatgctgaatagcccggtgtttactgcaaatcctcagttgcaggagcagatgcgtccacagctcccagctttcctgcagcagatgcagaatccagacacactatcagccatgtcaaacccaagagcaatgcaggctttaatgcagatccagcaggggctacagacattagccactgaagctcctggcctcattccaagcttcactccaggtgtgggggtaggggtgctgggaaccgctataggccctgtaggcccagtcacacccataggccccataggccccatagtcccatttactcccataggccccattgggcccataggacccaccggccctgcaggccctggctctactggctctggaggcccccctgggcccactgtttctagctctacacccaccgaaaccactagcccaacatcagaatctggacccaaccagcagttcattcagcaaatggtgcaggctctggctggggcaagtcctccacagctgccgaatccagaagtcagatttcagcaacaactggaacagctcaacgcaatggggttcttaaaccgtgaggcaaacttgcaggctctaatagcaacaggaggcgacatcaatgctgccattgaaaggctgctgggctcccagccatcctaattacatttctgtaccttgaaaaaaatgtatcttatttttgataatggctcttaaatctttaaacacacacaaaaacgtgctttactttcattttgattcttttaaatctaattataagtctaatatgcattttaaggtggagtccatccttctgtccctccttcctgtatctatccttcctgcctgcctgccttccttccttctttcctacctccctctatccctttctccttccttccttccttactttcttccttccttctctgttttgaatggtggtaattgtaatcaatgctgtttcactcaaaggtgttgcatgcaaacacttctctttattctgcatttattgtgatttttggaaaccggtatcagccttcactgttaagtgaataagttttgtcctacagatgtccaatttatttgcattttaaacattagcctataatagtaatttaatgtagaattaaaatattaaaaacaagcaaattatttgaagctctccaatttgtggtacaatattgcttattgtgactttggcatgtatttttgctagcaaaatgctgtaagatttataccattatttgctctttttgctatgttttacacagtacagtaagcacaattggaactgtacatctagaattattacaacagaatctaagcagaatatgtgtaaccaaaataagaaagaatataagaaatatttctggagctaggtatgtctcacagttttgtagaatcttacagcatctttgataaattcagtgaaaatgttggctaggcaagttcagttaaaatatagtagaaatgtttatcctggtatttctaagtatacatttaattgtacagaaaacttacagtgtgacattgtgtcaacattttcaaattaactgtatatgaccgtaatttttgtgcagcctgaaggatcagtgtagtaatgccaggaaagtgctttttacataagacttccttctcagcttttcccataaagagaccctaataagcattttgatctgtaattggaaatgtaactttcactgaaaagtgtcatgtgatgtttgcattacttttacctgctatgtataaaggaaactgtatcttttgactctatcagttatttctcttgtgcacagggaaaaatgcattaaaaatggctaaaaaaataaaaaaaattaaaaatggataaatcttttcttttttgccttctggctctaggatcatgtttagcaggattgccctacc

SEQ ID NO: 172 - DNA, 3253 bp, Bos taurus
acggcggcccggcggcggcggcggcggcggcggcggcggcggcccagagaccggagcgccgagaccgcgaaccgcggcctacacggagccttcttttcaccggaggaccagtgatctgcagtcttcaacacagaggtaccgtgctccgcgctccccgcccggtccggcccaacctgcagtggcagtgcctccttctttcctctctctctctctctctctcgcctgccggcgccttccctgactgcctgcgtcaccgcggccgccatggctgagaatggcgagagcagcggccccccgcgcccctcccgcggctctgctgcggcccaaggcccagcctctacccaggccgagcccaaaatcatcaaagtcactgtgaagacccccaaagagaaagaggagttcgcagtgcccgagaacagctcagtccagcagtttaaggaagcgatttcgaaacgcttcaaatcccaaacagatcagttagtgctgatttttgccggaaaaatcttaaaagatcaagataccttgatccaacatggcatccatgatggactgactgttcaccttgtcatcaaaagccagaaccgacctcagggccagtccacacagcctagtaatgccgcgggaactaatactaccaccgcgtcgactcccaggagtaactccacacctatttccacaaatagcaacccgtttggtttggggagccttggaggacttgcaggccttagcagcctcggcttgagctcgactaacttctctgagctccagaaccagatgcagcagcagctcttgtccagccctgagatgatgatccaaatcatggaaaatccctttgttcagagcatgctttcgaatcctgatctgatgaggcagctcattatggccaatccacagatgcagcaattgattcaaagaaacccagaaatcagtcacctgctaaacaacccagatataatgaggcagacccttgaaatcgccaggaatccagctatgatgcaggaaatgatgagaaatcaagacctggctctcagcaatcttgaaagcatcccaggtggctacaatgctttacggcgcatgtacactgacattcaagaacccatgcttaatgctgcacaagagcagtttggtggtaacccatttgcctccgtggggagcagttcctcttctggagaaggcacacaaccttcccgcacagaaaatcgtgatccactacccaatccctgggcgccaccaccggctacccagagttctgcgaccactagcacaacaactagcagtggcagtggatctggcagtagctccagcagtgctaccggaaacacagtggctgcagccaattatgtcgccagtatcttcagcaccccaggaatgcagagcttgctgcaacagataacggaaaacccccagctgatccagaatatgctgtctgcaccgtatatgagaagcatgatgcagtctctgagccagaatccagatttggctgcacagatgatgctgaatagccctgtgtttactacaaatcctcagctgcaggagcagatgcgtccacagctccctacttttttacagcagatgcagaatccagacacgttatcggccatgtcaaacccaagagcaatgcaggctttaatgcagatccagcaggggctacagacattagccactgaagctcctggcctcattccaagcttcactccaggtgtgggggtgggggtgctgggaacagctataggccctgtaggcccagtcacacccataggccccattggccccatagtcccgtttacgcccataggtcccattgggcccataggacccactggccctgcaggtccccctggctccactggcacaggcgcaccccctgggcctactgtgtctagctctgcacccagtgaaaccacgagcccaatatcggaatctggacccaaccagcagttcattcagcaaatggtgcaggctctggctggtgcaaatcctccgcagctgccaaatccagaagtcagatttcaacaacaactggaacagctcaacgcaatgggcttcttaaaccgggaagcaaacttgcaggctctaatagcaacaggaggcgacatcaatgcagccattgagaggctgctgggctcccagccatcgtaattacatttctgtaactggaaaaaatgtatcttatttttgataatggctcttaaatctttaaacacacacaaaattgtgctttactttcagtttgattctttcaactttgtctagttataaatttaatatgcattttaaggtggagtcctttcctccctctttgtttcctccctccctctctccttccttccctcccttcctctgttttgaatggtgagaatcaatgctgttttactcaaaggtgttgcatgcaaacacttctttattctgcatttattgtgatttttggaaacagatatcaacgtttacagttgggtgaacaagttttgtcctacagatgtccaatttatttgcattaaacattagcctatgatagtaatttaatgtagaatgaaaatattaaaaacagaaacattaattgaagctctataatttgtggtacaatattgcttattgtgactttggcatgtatttttgctagcaaaatgctgtaagatttatactatttgatctttttttgatatatttatacacagtacagtaagcacaattggaactgtacatctcgataaattgcagcagaatctctgagcagatatgtataaccaaaatgagaaagaatataagaaatatttctggagctcggtattatctcacaattttgtagaatcttacagcatctttgataaacttctcagtgaaaatgttgattaggtaagttcagttaaaatatagtagaaatgtttatcctggtatctctaagtatacatttaattgtacagaaaacagtgtgacgtgtcaacatttgcaaattgattgtatatgaacttaatcttagtgcagcctgaaggatcagtatagtaatgccaggaaagtgcttttttaagacttccttctcagcttctcccataaagagatcccagtacgcattttgatttgtaattggaaatgtaactttcactgaaagtgtcatgtgatgtttgcattacttttaactgctgtgtataaagaaaactgtatcttttgactccatcagttatttctcttgtgcacagggaaaatgcattaaaaatgactaaaaaaataaaaaatgaataaatttttttctttttgc

SEQ ID NO: 173 - DNA, 3459 bp, Rattus norvegicus
gggcgcggccgggggcgggacggggcgggagcgcgggcgccgcagctgcaggagtcgctgggagtgcgcgcgggcagatcacaaggcggcggcggcagagacggcctgcaggacctgctctctcagcccttagccgaggcctacgccgaaccgagtgcgcagccgacgaccgggaggagccgcagccctcatctctgaggtactgtgttccgcactgcccgccgggccgccccagtccgctgccgcggcgcctccttccctcgcgccctcttcgctcgccagcgccttccctgtgagcctgcgtcaccgcggccgccatggctgagaacggcgagagcagcggccccccgcgcccctcccgcggccctgctgcggccccaggcgcggccaacccgccagccgagcccaaaatcatcaaagtcactgtgaagacccccaaagagaaggaggagttcgcggtgcccgagaacagcaccgtgcagcagttcaaggaagcgatttctaaacgcttcaaatcgcaaaccgatcagctcgtgctgattttcgctggaaaaatcctgaaagatcaagacaccttgatccagcatggcatccatgatggactgactgttcacctggttatcaaaagccagaaccgtccgcagggccaggccaccacgcagcccagcactactgcgggaacgagcacgacgaccacgaccaccaccacggcggcggcgccgccggcggcgactacatcatcggctcccaggtgtagcaccacagctactaccacaaatagcagcaacttggggctcggaagccttgccagccttggtaacctgggtttgaactcgtccaacttcaccgagcttcagaaccagatgcagcagcagctcttggccagccccgagatgatgatccagatcatggaaaatccctttgttcagagcatgctttcgaatcctgatctgatgaggcagctcatcatggccaatccacagatgcaacaattgatccagagaaacccagaaatcagccacctactgaacaacccagatataatgaggcagactctcgaaatcgccaggaatcctgccatgatgcaagagatgatgagaaatcaagacctggctctcagtaatctcgaaagcatcccaggtggctacaatgctctgcggcgcatgtacactgacattcaagaacccatgctgaatgccgcacaggagcagtttgggggcaatccgtttgccacggtggggagcagttcctcctcaggggaaggtactcagccttcccgcacggagaatcgggatccgctgcctaatccttgggcaccaccgccaactacccagacctctgcgacgaccaccaccacgaccacaagcagtggcactgtggctggcagcaacaccagcagcactacggccgggaacaccatggctgcagctaattatgtggccagcatcttcagcaccccaggaatgcagagcctgctgcagcagataactgaaaatccccagctgattcagaatatgctgtctgcaccctacatgagaagcatgatgcagtcgctgagccagaatccagatatggctgcccagatgatgctgagtagcccactgtttacggcgaatcctcagctgcaggagcagatgcgtccacagctcccgaatttcctgcagcagatgcagagtccagaaaccatcgcggccatgtcaaacccgagagcgatgcaagcgctactgcagatccagcaggggctacagacactagccactgaagcacctggcctcattccaggcttcactccaggtgtgggggtgggagtgctgggaacggccataacccctgtgggcccagtcactcccatagggcccatcggtcctatcgttcctttcacccccataggccccatcgggcctataggacccactggccctgccagctcccctggctcgaccggcaccgggatcccgcctgcaaccactgtgtccagctctgcacctactgaaaccataagtccaacatcagaatctggacccagccagcagttcattcagcaaatggtgcaggctctcactggaggaagtcctccacagccgccgaatcctgaagtgagatttcagcagcaactggaacagctcaacgccatggggttcttaaaccgcgaagcaaacttgcaggccctaatagcaacaggaggcgacatcaacgcggccattgagaggctgctgggctctcagccatcctaattccgtttctgtaccttgaaaaaaatgtatcttatttttgataatggctcttaaatctttaaacacacaaaatcgtgctttacttttattttgattcttttaaatctgtctacgtataaatctaaaacgaagcattttaaggtggagtccctcccttcctgctccctcctcctccccctcctcctccccccctcccccagcctcccacccaccctctccccttctagcctgccctctcccctctttgtttccttccctccttcattcctttctttttttttcttttgatttccttccttctctgatttgaatggtgggaatcaatactgtttcactcaaaggtgttgcatgcaaacacttctctttattctgcatttattgtgatttttggaaacaggtatcagccttcacagttgggtgaacaagttttgtcctacagatgtccagtttctttgcattttaaacattagcctatgatagtaatttaatgtagaatgaagatattacaaaacagaagcaaattatttgaagctctctaatttgtggtaaaatattgcttattgtgactttggcatgtatttttgctagcaaatgctgtaagatttataccattcattggttgtttttgctatttgtacacagtacagtaagcacaactggaattgtacatctagaagcattactgtagaatctgagcagattatgtgtaaccaaaataagaaagagtataagaaataatcctgaagctaggtatgtctcacaattttgtagaatcttacagcatatttgataaatttctcagtgaaaatgttggctaggcaagttcagttaaaatatagtagaaatgtttatcctggtttctctaagtatacattaattgtacagaaaacttacagtgtaacattgtgtcaacagttgcagattgattgtatatgaccttaatctttgtgcagcctgaaggatcagtgtagtgacgccaggaaagtgctttttacctaagagttcctcagcttctcccatgaagagaccttcataatgcattttgatttgtaattggaaatgtaacttttactggaagtgtcatgtgatgtttgcattacttttaactgctatgtataaaggaaagtgtatcttttggctctatcagttatttctcttgtgcacagggaaaaatgcattaaaatgactaaaaaaataaaaaaataataaaaaatggagaaagctc

SEQ ID NO: 174 - DNA, 1847 bp, Homo sapiens
gtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 175 - DNA, 1897 bp, Pan troglodytes
aaaactctgccactctcgctccgaggtccccgcgccagagacgcagccgcgctcccaccacccacacccaccgcgccctcgttcgcctcttctccgggagccagtccgcgccaccgccgccgcccagcccatcgccaccctccgcagccatgtccatcaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctatgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccagggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcagtctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgatgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtcccccacctgtgaagtggatgcccttaaaggaactaatgagtccctggaacgccagatgcgtgaaatggaagagaactttgccgttgaagctgctaactaccaagacactattggccgcctgcaggatgagattcagaatatgaaggaggaaatggctcgtcaccttcgtgaatatcaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaagaagaaatccatatcttaaagaaacagctttcaagtgcctttctgcagttcttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttctccagcaagtatccaaccaacttgtttctgcttcaataaatctttggaaaaactcaaaaaaaaaaaaaaaaaaaaaaa

SEQ ID NO: 176 - DNA, 1910 bp, Canis lupus
ccccgagccgctcggagccctcgcggccggcgggcagcagggctcgtcctctgccactctcgctccgggtccccgcgccagagccgcagcagcgcgcccgccgcccgcagccaccgcgccctcgcccgccggtcctccccgagccggtccgtgccgccgcagccgcgcagcccaccgccgccctccgcaccatgtccaccaggtctgtgtcctcgtcctcctaccgcaggatgttcggcggcccgggcaccgggagccggccgagctccacgcggagctacgtgaccacgtccacccgcacctacagcctgggcagcgcgctgcgccccagcaccagccgcagcctctacgcctcgtccccgggcggcgcgtacgccacgcgctcctccgcggtgcgcctgcggagcagtgtgcccggcgtgcgtctgctgcaggactcggtggacttctcgctggccgacgccatcaacaccgagttcaagaacacgcgcaccaacgagaaggtggagctgcaggagctgaacgaccgcttcgccaactacatcgacaaggtgcgcttcctggagcagcagaacaagatcctgctggccgagctcgagcagctcaagggccagggcaagtcgcgcctgggggacctctacgaggaggagatgcgggagctgcgccggcaggtggaccagctcaccaacgacaaggcccgcgtcgaggtggagcgcgacaacctggccgaggacatcatgcggctgcgggagaagttgcaagaggagatgcttcagagagaggaagccgagagcaccctgcagtctttccgacaggatgttgacaatgcttctttggcacgtcttgaccttgagcggaaagtggaatccttgcaagaagagattgcctttttgaagaaactacatgatgaggaaatccaggagctgcaggcccagattcaggaccagcatgtccaaatcgatatggatgtttccaagcctgacctcacggctgccctgcgtgatgtacgccagcaatatgaaagcgtggctgccaagaaccttcaggaggccgaggaatggtacaagtccaagtttgccgacctctctgaggctgctaaccggaacaatgatgccctgcgccaggcgaagcaggagtcaaatgagtaccggagacaggtgcagtccctcacctgcgaagtggatgcactcaaagggactaatgagtctctggaacgccagatgcgtgaaatggaagagaactttgccgtcgaagctgctaactaccaagacactattggccgcctgcaggatgagattcagaacatgaaggaagaaatggctcgtcaccttcgggagtaccaggacctgctgaatgttaagatggctctcgacattgagattgccacctacaggaagctgctggaaggcgaggagagcaggattgctctgcctcttccaaacttttcttccctgaacctgagggaaaccaacctggattcactccctctggttgacactcactcaaaaagaacgcttctgattaagacggttgaaactagggatggacaggttatcaacgaaacttctcagcatcatgatgaccttgagtgaagcttgcccagattcggtgcagcaattactaccagcaagaataaaaaaaaaaagaaattcgtatcttaaagaaacagctttcaagtgcctttctgcagtttttcaggagcgcaagatagatttggaattaggagtaacctctagttcttaagaaccaacactcttaaaagatttaggagaaagtttacaacataatctagtttacgaagaaaacttgtgctagaatactttttaaaaagtatttttgaataccattaaaactgcttttttccaacaagtatctgaccaacttgtttctgcttcaataaatctttggaa

SEQ ID NO: 177 - DNA, 1876 bp, Bos taurus
gtgtccccgcgccagagacgcagcagcgctccctctgcccacacccaccgcgccctcgcgctcgcctctccttccggagccagtccgtgctaccgcagtcgcccagtccaccaccaccctctgcagccatgtccaccaggtccgtgtcctcgtcctcctaccgcaggatgttcggcggccccggcaccgcaagtcggccgagctccacccggagctacgtgaccacatccacccgcacctacagcctgggcagcgcgctgcgccccaccaccagccgcaccctctacacctcgtccccgggtggcgtgtacgccacgcgctcctcggccgtgcgcctgcggagcggcgtgcccggcgtgcggctgctgcaggactcggtggacttctcgttggccgacgccatcaacaccgagttcaagaacacccgcaccaacgagaaggtggagctgcaggagctcaatgaccgcttcgccaactacatcgacaaggtgcgcttcctggagcagcagaacaagatcctgctggctgagctcgagcagctcaagggccagggcaagtcgcgcctgggggacctctacgaggaggagatgcgagagctgcgccggcaggtggaccagctcaccaacgacaaagcccgcgtcgaggtggagcgcgacaacctggccgaagacatcatgaggctccgggagaagttgcaggaggagatgcttcagagagaggaagccgagagcactctgcagtctttcagacaggatgttgacaatgcctctttggcacgtcttgacctggagcgtaaagtggaatccttgcaagaagagattgcctttttgaagaaactgcatgatgaggaaatccaggagcttcaggcccagattcaagaacagcatgtccaaatcgatatggatgtttccaagcctgacctcacggctgccctgcgtgatgtccgtcagcagtatgagagcgtggccgccaagaaccttcaggaggctgaggaatggtacaagtccaagtttgctgacctctctgaagctgctaaccgcaacaatgatgccctgcgccaggccaagcaggagtcaaatgagtaccgccggcaggtgcagactcttacctgcgaggtggatgcgctcaaagggactaacgagtctctggaacgccagatgcgtgaaatggaagagaacttctctgtggaagctgctaactaccaagacactattggccgcctgcaggatgagattcagaacatgaaggaagagatggctcgtcacctgcgcgaataccaagacctgctgaatgtcaagatggcgctcgacatcgagatcgccacctacaggaagctgctggaaggagaggagagcaggatttctctgcctcttccaaacttttcttccctgaacctgagggaaaccaatctggattcactccctctggttgacactcattcaaaaaggacacttctgattaagacggtggaaaccagagatggacaggttatcaacgaaacttcccagcatcacgatgatctggaataaaaactgcacatacttcgtgcagcaaaatactaccagcaagaaggaaaaaaaaaaatccatatcttaaagaaacagctttcaagtgcctttctgcagttttttcaggagcgcaagatagatttggaataggaataagccctagttcttgaaccaacacccgtaaaagatttagaaaaaagtttacaacataatctagtttaccgaagacgccttgtgctagaatactttttaaaaagtatttttgaataccattaaaactgcttttttccatcaagtatctgaccaacttgtttctgcttcaataaatctttggaaaactcaaaaaaaaaaaaaaaaaaaaaaaaaaa

SEQ ID NO: 178 - DNA, 2174 bp, Mus musculus
ccacgcccctttggcccagtgccagggatcgctttactcaactttccagagccccccttccttcccccatgaatccttcccgcgatcccttctttctcagcacccaagggtgagtagagagttcgggtgatcaccaggaaagcccctgaaaggcctagcacttccaattagtaacaggactgtgcttgataccctacagccctggaggaaggctcgaggggagctccctcccccaccccccttcctcacttctttccgggtccccattggctggctcgctcggcggctaggatggcagtgggaggggaccctctttcctaacagtgttataaaagcagcgcccttggcgttgtccagtcctctgccactcttgctccgggaccccagagaccccagcgctcctacgattcacagccaccgcgccctcattcccttgttgcagtttttccagccgcagcaagccagcccaccttcgaagccatgtctaccaggtctgtgtcctcgtcctcctaccgcaggatgttcggtggctccggcacatcgagccggcccagctccaaccggagctatgtgaccacgtccacacgcacctacagtctgggcagcgcactgcgccccagcactagccgcagcctctattcctcatcccccggtggcgcctatgtgacccggtcctcggcagtgcgcctgcggagcagcgtgccgggcgtgcggctgcttcaagactcggtggacttctcgctggccgacgccatcaacactgagttcaagaacacccgcaccaacgagaaggtagaactgcaggagctgaatgaccgctttgccaactacatcgacaaggtgcgcttcctcgagcagcagaacaaaatcctgctggctgagctcgagcagctcaagggccagggcaagtcgcgcctgggcgacctgtacgaggaggagatgcgggagctgcgccggcaggtggatcagctcaccaacgacaaggcccgtgtcgaggtggagcgggacaacctggccgaggacatcatgcggctgcgagagaaattgcaggaggagatgctccagagagaggaagccgaaagcaccctgcagtcattcagacaggatgttgacaatgcttctctggcacgtcttgaccttgaacggaaagtggaatccttgcaggaagaaattgcctttttgaagaaactgcacgatgaagagatccaggagctgcaggcccagattcaggaacagcatgtccagatcgatgtggacgtttccaagcctgacctcactgctgccctgcgtgatgtgcgccagcagtatgaaagcgtggctgccaagaacctccaggaggccgaggaatggtacaagtccaagtttgctgacctctctgaggctgccaaccggaacaacgatgccctgcgccaggccaagcaggagtcaaacgagtaccggagacaggtgcagtcactcacctgtgaagtggatgcccttaaaggcactaacgagtccctggagcgccagatgcgtgagatggaagagaattttgcccttgaagctgctaactaccaggacactattggccgcctgcaggatgagatccaaaacatgaaggaagagatggctcgtcaccttcgtgaataccaagatctgctcaatgttaagatggccctggacattgagatcgccacctacaggaagctgctggaaggcgaggagagcaggatttctctgcctctgccaaccttttcttccctgaacctgagagaaactaacctggagtcacttcctctggttgacacccactcaaaaagaacactcctgattaagacggttgagaccagagatggacaggtgatcaatgagacttctcagcatcacgatgaccttgaataaaaattgcacacacttggtgcaacagtgcagtaccagcaagaaggaaaaaaaaaatcgtatcttaggaaaacagctttcaagtgcctttactgcagtttttcaggagcgcaagatagatttggaatagaaagaagctcagcacttaacaactgacaccccaaaagcgtagaaaaggtttacaaaataatctagtttacgaagaaatcttgtgctagaatactttttaaagtatttttgaataccattaaaactgcttttttccagtaaatatctgaccaacttgttactgcttc

SEQ ID NO: 179 - DNA, 1796 bp, Rattus norvegicus
gttcacagccactgcgccctcgctctcttcttgcagatcttgcagccgcagcaagccaggccacctcgtccttcgaagccatgtccaccaggtccgtgtcctcgtcctcctaccgcaggatgttcggtggctccggcacatcgagccggcccagctccaaccggagctatgtgaccacatccacccgcacctacagcctaggcagcgcgctgcgccccagcactagccgcagcctctattcctcgtccccgggtggcgcctatgtgacccggtcctccgccgtgcgcctgcggagcagcatgcccggcgtgcggctgctgcaggactccgtggacttctcgctggccgacgccatcaacaccgagttcaagaacacccgcaccaacgagaaggtggaattgcaggagctgaatgaccgcttcgccaactacatcgacaaggtgcgcttcctcgagcagcagaacaaaatcctgctggccgagctcgagcagcttaagggccagggcaagtcgcgcctgggcgacctctacgaggaggagatgagggagttgcgccggcaggtggatcagctcaccaatgacaaggcccgtgtcgaggtggagagggacaacctggccgaggacatcatgcggctgcgagaaaaattgcaggaggagatgctccagagggaggaagccgagagcaccctgcagtcattcagacaggatgttgacaatgcttctctggcacgtcttgaccttgaacgtaaagtggaatccttgcaggaagaaattgcctttttgaagaagctgcacgatgaagagatccaggagctgcaggcccagattcaggaacagcatgtccagatcgatgtggacgtttccaagcctgacctcaccgctgccctgcgtgatgtccgccagcagtatgaaagtgtggctgccaagaacctccaggaggccgaggaatggtacaagtccaagtttgctgacctctctgaggctgccaaccggaacaacgatgccctgcgccaggcaaagcaggagtcaaacgaataccggagacaggtgcagtcactcacctgcgaagtggatgcccttaaaggcactaatgagtccctggagcgccagatgcgtgaaatggaagagaattttgcccttgaagctgctaactaccaggacactattggccgcctgcaggatgagatccagaacatgaaggaagagatggctcgccaccttcgtgaataccaggacctgctcaatgtaaagatggctcttgacattgagatcgccacctacaggaagctgctggaaggggaggagagcaggatttctctgcctcttccaaacttttcttccctgaacctgagagaaactaacctggagtcacttcctctggttgacacccactccaaaagaacactcctgattaagacggttgaaaccagagacggacaggtgatcaatgagacttctcagcaccacgatgaccttgaataaaaactgcacaggctcagtgcaacggcgcagtaccagcaagaaggaaaaaaaaatcgtatcttagaaaaaagagctttcaagtgcctttactgcagttttcaggagcgcaagatagatctgggatagaaacgagctcagcacataacaactgacacccccaaaaggcgtagaaaaggtttacaaaataatctagttttacgaagaaatcttgtgctagaatactttttaaagtatttttgaataccattaaaactgctttctttttccagaaaatatctgaccaacttgttactgcttcaataaaacttcagaaat

SEQ ID NO: 180 - DNA, 1697 bp, Homo sapiens
gcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaag

SEQ ID NO: 181 - DNA, 2772 bp, Pan troglodytes
atgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcaggtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagccccctcccctcgcctcctcccctgagcagccggcggcgggagtactgcttcaggccagagccgagaggcgctggcggcggctggaccgcgaggtgggctcggtgggcggcgccgagctcggctctgctgggaggcgcggacagcctggggctgccacctgccccaccgggtcccggcgcacaaagctacacgcctctctgcagccctctgccctgcttcgcgttccggagccgcggtcgccacccaagcaggcgggaggcctggcactgcgggagtcaaggcctaagcagggcttcagctcggggtttaggggctgggacactcacagccccagtcacgggccccccggaagagtgtgtcattttcagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcactgcttcaaggagcggactcggagcctgttgcgggagtggtacctgcaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcggacaccggcacctccatcctctcggtaacctccagcgactcggaatgtgatgtatgatagccaaggccgccctcctccccctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatgtataaaaaacaggaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagaggacaaaagcaaaacagacaaaaagaaaaaaaatcgccgtctccgttccgaatttgttaaaaaaaaaaaaaaaaaaaagacagggggaaaaaaaaaaaaagaactcctggagagggaaatagcaaatgtgtcttgccttttgttgctctctctctctttttttttctctcgctctctttctttctcttcttctctctgtttttaagtcaagtattggtcaaaaaaatgcaatcttctgttttttgttcagcagacaatcattttcttcgtaagcacctttttctctcaactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctatcttcctccctgctcacctgtctcttttctttttggggttctcctcccactcggtgctcctggtgtcgacttggcagtcaaggaggggcatggtggcctgggttaggaagagggaccccgtcgctagcaaaagtggagagtgagattgtagtattcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcactccca

SEQ ID NO: 182 - DNA, 2436 bp, Bos taurus
gcgggtgtgtgtgtgtgtggatgtgttcggggtgtgggtgtcccttacgcccttcctcctccccctcctcctgctcccccctccttccctcctccgcctcccccctctcctctccctcctcctcgtccccatcgcccctctcctcctcttcctcccctctctcttcctctccctgaattttctcctctcctctcaggtcggtccatggtattccgctcccccctagacctctattcctcccacttcttgttgccaaacttcgccgattctcaccaccgctccctacttctggcgagtagcggcggcgggaacggctcgggaggcggcggcggcggcagcggcgggaacggtgtgggaggcggcggtgctggcggagcgggaggcggcggcggcggcggctccagggcccccccggaagagttgtccatgttccagctgcccaccctcaacttctcgccggagcaggtggccagcgtctgcgagacgctggaggagacgggcgacatcgagcggctgggccgcttcctctggtcgctgcccgtggcccccggggcgtgcgaggccatcaacaagcacgagtcgatcctgcgcgcgcgcgccgtggtcgctttccacacgggcaacttccgcgacctttaccacatcctggagaaccacaagttcaccaaggagtctcacggcaagctgcaggccatgtggctcgaggcgcactaccaggaggccgagaagctgcgcggccgcccgctcggcccggtggacaagtaccgcgtgcgcaagaagttcccgctgccgcgcaccatctgggacggcgagcagaagacgcattgcttcaaggagcggactcggagcctgctgcgggagtggtacctgcaggacccctaccccaaccccagcaagaaacgcgaactggcgcaggccaccggcctcactcccacacaagtaggcaactggtttaagaaccggagacagcgcgaccgcgccgcggcggccaagaacaggctccagcaccaggccattggaccgagcggcatgcgctcgctggccgagcccggatgccccacgcacggctcagcagagtcgccgtccacagcggccagccccaccaccagcgtgtcgagcctgacggagcgcgcggacaccggcacctccatcctctcggtaacctccagcgactcggaatgtgatgtatgatacccaaggccgccctcctcccctctccccgctccttcccctcctcctccttgactgcctcctcttcctcctccacccccagaacaaaccgaaatcaggatacacaatcatacacacacctaaatacacacacacttccactccagccaaaaatatataaaaaccaagaaaaataacaagttaaacgcaaaccatcaacaactcccaaccaccatctaccaccacggccaccccaaaggaccgcgacagccaacagacagtcacaagcgctgatacggcgggcagacagcataaaagaggtgacaattgtatactttctaggacaagcaccgcttctcctttcggttcccacggacccggcaccccacctgcatgacgatttatttgtatctgggaaaatactctctctagttaaaaacgattaaaaaagagtcgactatacaaaaaccgaccgccaccacgacgacaagacgacaaaagcaaaacagacaaaaagagaagaaaaaaaaccgccatctccgttcggaatttgttaaaaaaaaaaaaaagaactcctcgagagggaaatagcaaatgtttctcgccttttgttgcgctctctcttttttcctctcttgctctctttctttctctgtttttaagtccaagtattggtcaaacaaaatgcaatcttctgttttttgttcagcagacaatcattttcttgttaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctttctctcccacctttttcctccctccccactcacctgtctctttcctttttggggttcccctcccactcgatgttcctggcgtcgacttggcagtcaaggcgtggcgtggtgggctgggtgaggaagagggaccctgtcgcttgcaaagcggagagtgagactgtagtattcttatgcaaaagctatttcaagtatttcttagctgctttggaggtatctctcactccccgtagggcgcttttactgttatcttaactgcgtgtttatctatatgtaaaaactttctaaagcaaatacagtattctccattttcttatca

SEQ ID NO: 183 - DNA, 1651 bp, Mus musculus
attgctgtggaatcgctgaatcttgactcggccgtggttggctctcgctctcctctctccctctccctctctctgcctcgggctcgcgctctctctctctctctctctctctctctctctctctctctctctctctctctctctctctgcgcgcgcgcaccgggccgctctccttcctccctctctatgtggctgcgcgggtgtgtgtgtatgtggatgtgtgtggggtgtgggtgtcccttacgtccttcctcctccccctccttctccttctgctcccccctcctttccatctcctcctcccccctctcctctccctcctcctggtcctcatcgcccctctcctcctcttcctcccctctctcttcctctccctgaattttttcctctcctctcaggtcagtccatggtattccgctcccccctagatctctattcctcccacttcttgttgccaaacttcgccgattctcaccactgctccctacttctggcgagtagcggcggcgggagcggtgcgagcggcggcggcggcggcgcgggaggaggcggcggcgggaaccgtgcgggaggcggcggtgctggcggagcaggcggcggcagcggcggcggcggctccagggcccccccggaagagttgtccatgttccagttgcccaccctcaacttctcgccggagcaggtggccagcgtctgcgagacgctggaggagacgggcgacatcgagcggctgggccgcttcctctggtcgctgcccgtggcccccggggcgtgcgaggccatcaacaaacacgagtcgatcctgcgcgcgcgcgctgtcgtcgccttccacaccggcaacttccgcgacctgtaccacatcctggagaaccacaagttcactaaggagtctcacggcaagctgcaagccatgtggctcgaggcgcactaccaggaggccgagaagctgcgcggccgcccgctcggcccggtggacaagtaccgcgtgcgcaagaagttccctctgccgcgcaccatctgggatggcgagcagaagacccattgcttcaaggagcggactcggagcctgctgcgggagtggtacctgcaggatccctaccccaaccccagcaagaaacgcgaactggcgcaggccaccggcctcacccccacacaagtaggcaactggtttaagaaccggcgacagcgcgaccgcgcagcggcggccaagaacaggctccagcatcaggccatcgggccgagcgggatgcgctcgctggccgagcccggctgccccacgcacggctcagcagagtcaccgtccacggcggccagcccgaccaccagtgtgtccagcctgacggagcgcgcggacaccggcacttcgatcctctcggtaacctccagcgactcggaatgtgatgtatgatagccaaggccgccctactcctccccctcctccccttccaccttcccctcctcttcgtaaccctgctcctcttcctcttcttctactccatccctagaacaaaccgaaatcaggatacacagacagatacacacacaagtccatacacactcccaccccagccaaaaatatatttaaaaaaaaacaagaaaaataaattaacctcaaaccatcaacaaccccaccaccacctactaccacggc

SEQ ID NO: 184 - DNA, 1598 bp, Rattus norvegicus
gaattcggcacgagaatcgctgaatcttgactcggcggtggttggctctcgctctcctctctctccctctccctctccctctccctctctctgcctcgggttctctctctgcgcgcgcaccgggccgctctccttcctccctctctatgtggctgcgcgggtgtgtgtgtatgtggatgtgtgtggggtgtgggtgtcccttacgtccttcctcctccccctccttctccttctgctcccccctcctttccatctcctcctcccccctcttctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccactgctccctacttctggcgagtagcggcggcgggagcggtgcgggcggcggcggcggcgcgggaggaggcggcggcggcggcggcgggaaccgtgcgggaggcggcggtgctggcggagcaggcggcggcggcggcggcggcggcggcggctccagggcccccccggaagagttgtccatgttccagctgcccaccctcaacttctcgccggagcaggtggccagcgtctgcgagacgctggaggagacgggcgacatcgagcggctgggccgcttcctctggtcgctgcccgtggcccctggggcgtgcgaggccatcaacaaacacgagtcgatcctgcgcgcgcgcgccgtcgtcgccttccacaccggcaacttccgagacctgtaccacatcctggagaatcacaagttcaccaaggagtctcacggcaagctgcaggccatgtggctcgaggcgcactaccaggaggccgagaagctgcgcggccgccctctcggcccggtggacaagtaccgcgtgcgcaagaagttccctctgccgcgcaccatctgggatggggagcagaagacccattgcttcaaggagcggactcggagcctgctgcgggaatggtacctgcaggatccctaccccaaccccagcaagaaacgagaactggcgcaggccaccggcctcacccccacacaagtaggcaactggtttaagaaccggcgacagcgcgaccgcgcagcggcggccaagaacaggctccagcaccaggccatcgggccgagcgggatgcgctcgctggccgagcccggctgccccacgcacggctcagcagagtcaccgtccacggcagccagtccgaccaccagtgtgtccagcctgacggagcgcgcggacactggcacttctatcctctcggtaacctccagcgactcggaatgtgatgtatgatagccaaggccgccctcctcctccttcccctcctccccctccaccttcccctcctcctcctagccctgctcctcttcctcctcttctactccatccctagaacaaaccgaaatcaggatacacagccacacacacacacacacacacacacacacaagtccatacacactcccaccccagccaaaaatatatttaaaaaaaaaaaaaaaaaactcgag

SEQ ID NO: 185 - DNA, 2885 bp, Homo sapiens
ttgtcctgagcgcggagagggcgagctcgggccgcgggcagggcgggagccggcagccggcaaccaagggaggcagaaaggcacaaagatcgcaataatatccgttataacccgctatctaaccccacccccaacacacacccatccatcccaccctccgggagaggcagccggcgatccgctctctgcgccctgggaaaaagccccagccatgagcaatcagtaccaggaggagggctgctccgagaggcccgagtgcaaaagtaaatctccaactttgctctcctcctactgcatcgacagcatcctgggccggaggagcccgtgcaaaatgcggttgctgggagccgcgcagagcttgcctgctccgctgaccagccgcgccgacccggaaaaggccgtgcaaggctcccctaagagcagcagcgccccgttcgaggccgagctgcacctgccgcccaagctgcggcgcctgtacggcccgggcgggggccgcctccttcagggtgcggcagcggcggcggcggcggcggcggcggcggcggcagcggccgccacggccacggcgggtccacgcggggaggcccctccgccgccaccgccaaccgcgcggcccggggaacggccggacggcgcaggggccgccgcggcagccgcggccgcggccgccgcggcctgggacacgctcaagatcagccaggcgccgcaggtgagcatcagccgcagcaagtcgtaccgcgagaacggggcgcccttcgtgccgccgccgcccgcgctggacgagctgggcggcccggggggcgtcacgcacccggaggagcgcctcggcgtggccggcggcccgggcagcgccccggctgcgggtggtggcaccggcaccgaggacgacgaggaggagctgctggaggacgaagaagatgaggacgaggaagaggaactgctggaggacgacgaggaggagctgctggaggacgacgcccgcgcgctgctcaaggagccccggcgctgtcctgtggccgccactggcgccgtggccgcagcagctgccgctgcagtggccacagagggcggggagctgtcacccaaggaggagctgctgctgcacccggaagacgctgagggcaaggacggcgaggacagcgtgtgcctctctgcgggcagcgactcggaggaggggctgctgaaacgcaaacagaggcgctaccgcaccacgttcaccagctaccagctggaggaactggagcgggccttccagaagacgcactacccggacgtcttcaccagggaggaactggccatgaggctggacttgaccgaggcccgagtccaggtctggttccagaaccgtcgggccaagtggcgcaagcgggagaaggcaggcgcgcagacccacccccctgggctgcccttcccggggccgctctccgccacccacccgctcagcccctacctggacgccagccccttccctccgcaccacccggcgctcgactccgcttggactgccgctgccgccgccgccgccgccgccttcccgagcctacctccgcctccgggctcggccagcctgccgcccagcggggcgccgctgggcctgagcactttcctcggagcggcagtgttccgacacccagctttcatcagcccggcattcggcaggctcttttccacaatggcccccctgaccagcgcgtcgaccgcggccgcgctcctgagacagcccacacccgccgtggagggcgcagtggcatcgggcgccctggccgacccggccacggcggccgcagacagacgcgcctctagcatagccgcgctgaggctcaaggccaaggagcacgcggcgcagctcacgcagctcaacatcctgccgggcaccagcacgggcaaggaggtgtgctaaaggctgccctccacacccgcgccccgcgcgcgccccgaaaggtcacctcactcagcaccactcaagaccaaatggaaacagaggaccagcacactcccgagacggcactgagagagcgcagccgccttcacagcagtctggatgcgggcatggcagccctcggcgctccgggacgtggcacctcctcggctggctgtccacccgcccctgcccctgcccctgctactgccaacctcgctccaactccaacatccactctctcttgttcttactttcctgaaaatatcggggaggttttctcccccagacgcctgatattgaagtaaaaaatttaaaaagcccaacctcttcctcctgacaccccacttagcctttcttttctttctttctttctttcttttttttttttaaatagcattttggcgctcgaagttgatctccccagcgagggccccagcgtgaagccagggcccgggaagcaaatgcgagcctgtaagatagctaacagtgcacttaaaggaaaggggcgtcttgttcttgttctcttctttatcatacaccaaccaaggtttttatatcaaaccaaagggaaataatactctgctagaatatggactgttgaagtcaccaaactgtgattattgattctgtacataccattgttattaaaaaaaaaaaaaaaagaacagagctttgtatatttgaaatgttataacgcaattgcactcagcgtggtatggtaaaagtttgtcctcccgtagattcttactgtgttgtagatacggtagggttcctagacaaatatttatgtactcaagccctttatttaacttattaactgtagaggcttccgaaaccttcaagataaaggcaatggtacagtacttttgtgtaatgtgtaattgttaccacttttccttgctatctagtggagaagtgtcacgctcaaaataaaaaaattatatgtttaacaaaaaaaaaaaaa

SEQ ID NO: 186 - DNA, 1824 bp, Canis lupus
atgagcaatcagtaccaggaggagggctgctccgagaggcccgagtgcaaaagtaaatctccaactttgctctcctcctactgcatcgacagcatcctgggccgaaggagcccttgcaaaatgcggctgctgggagccgcgcagagcttgcccgccccactggccagccgcgccgaccaggaaaaggccgtgcaaggtaaggaaagagagagaacaactccgaggcctggtgcctcaaagagcggcacacgtctcgccagggtctggggtccgaggccgggagcgcgcgggaggagggggccggggcctggggcgagagcggctggccggcgcgctgaccgctctcccttgcccgcaggctcccccaagggcagcggcgccccgttcgaggctgagctgcacaagcagcacccaaccgcgcggcccggggagcggcccgacggcgcgggggccgccgtgcccgccgcggcggcggccgccgcggcctgggacacgctcaagatcagccaggcaccgcaggtgagcatcagccgcagcaagtcgtaccgcgagaacggggcgcccttcgtgccgccaccgcccgcgctggacgagctgggtggcccggggggcgccgcgcacccggacgagcgcctcggcgcggccagcggccccggtggcgccccggcggcgggtggcggtacgggcgccgaggacgacgaggaggagctgctggaggatgaagaggacgaagacgaagaagaggagctgttggaggacgacgaggaggagctgctggaggacgacgcccgcgcgctgctcaaggagccccggcgctgcgccgtggccgccactggcgcggtggccgccgccgccgccgccgccgccgccgccgccgccgtggccacagagggcggggagctatcgcccaaggaggagctgctgctgcacccggaggacgccgagggcaaggacggcgaggacagcgtgtgcctgtctgcgggcagcgactcggaggaggggctgctgaagcgcaagcagcggcgctaccgcaccacgttcaccagctaccagctggaggaactggagcgggccttccagaagacgcactacccagacgtcttcaccagggaggaattggccatgaggctggatttgactgaggcccgagtccaggtctggttccagaaccgtcgggcgaagtggcgcaagcgggagaaggcgggcgcgcagacccaccccccggggctgcccttcccggggccgctgtcggccacgcacccgctgagcccctacctggacgccagccccttcccgccgcaccaccccgcgctcgactcggcctggacggccgccgccgccgccgccgccgccgccttcccgagcctccctccgcctccgggctcggccagcctgccgcccagcggggcgccgctgggcctgagcactttcctcggagccgccgtgttccgacacccggccttcatcagcccggcgttcggcaggctcttttccaccatggcccccctgaccagcgcgtcgaccgcggccgcgctcctgagacagcccacgccggccgtggagggcgcggtggcgtcgggcgcgctggccgacccggccaccgtggccgcagacagacgcgcgtctagcatagcggcgctgaggctcaaggccaaggagcacgccgcgcatcttacgcagcttaacatcctggcgggcaccagcacgggcaaggaggtgtgctaaaggctgccctcctccctcgcgccccgggcgcaccccgaaaggtcacctcactcagcaccactcaagaccaaatggaaacagaggaccagcacactcccg

SEQ ID NO: 187 - DNA, 2759 bp, Mus musculus
ccaacacacacccttttcatccaaccctccaggagagaggagcagaggtccgctctctgagcccaaggaaaaagcaccagccatgagcaatcagtaccaggaagagggctgctctgagaggccggagtgcaagagtaaatctccaactttgctctcctcctactgcatcgacagcatcctgggccggagaagcccatgcaaaatgaggcttctgggagccgcgcagagcttgcctgccccgctggccagccgcgctgaccaggaaaaagccatgcaaggctcccccaagagcagcagcgccccgttcgaggctgagctgcacctgccacccaagctgcggcgcctctacggcccgggcgggggccgcctcctccagggcgcggcggcggcggctgcagcggcggcggcggccgcagcggcggccacggccactggcaccgcaggtccccgtggagaggttcctccaccgccaccaccagctgcacggccaggggagcgtcaggacagcgcaggggccgtggctgccgccgctgccgccgctgcctgggacacgctcaagatcagccaggcgccgcaggtgagcatcagtcgtagcaagtcgtaccgcgagaacggggcgcccttcgtgcccccgccgccagccctggacgagctgagtggcccggggggcgtcgcgcaccccgaggagcgcctcagcgcggccagcggacccggcagtgcccccgcggcgggtggtggcacgggcgccgaggacgacgaggaggagctgttggaggatgaggaagatgaagaggaggaagaggagctgctggaggacgacgacgaggagctgctggaggacgatgcccgcgcgctgctcaaggagccccggcgctgctcggtggccaccaccggcacagtggccgccgccgccgccgctgctgccgccgccgtggccaccgagggcggggagctgtcgcccaaggaagagctgttgctgcacccggaggacgccgagggcaaggatggtgaggacagcgtgtgcctgtcggccggcagcgactcggaggaggggctgctgaagcgcaaacagaggcgctaccgcaccacgttcaccagttaccagctggaggaactggagcgggctttccagaagacgcactaccctgacgtcttcaccagggaggagctggccatgaggctggacctgacagaggcccgagtccaggtgtggttccagaaccgtcgggccaagtggcgcaagcgggagaaggctggcgcacagacccaccccccggggctgccctttccagggccgctctcggctacccaccctctcagcccctacctggacgccagcccctttcccccgcatcaccctgcgcttgattcggcctggaccgccgcggcggcggcggctgcagctgccttcccgagcctacctccgcccccaggctctgctagcctgccacccagcggggcgccgctgggtctgagcacttttctaggagcagcggtgttccgccacccagccttcatcagcccagcatttggcaggctcttttccactatggcccccctgaccagcgcgtcgactgcggctgcgctcctgagacagcccacacccgcggtggagggcgcagtggcctcgggcgcgctggccgacccggccaccgccgcggcagacagacgcgcgtcaagcatagccgcgctgaggctcaaggctaaggagcacgccgcgcagctcacgcagctcaacatcctgccgggcaccagcacggggaaggaggtgtgctaaaggctgccctccgcccttgcgcccctagggcgttccccgaaaggtcacctcactcagcaccactcaagaccaaatggaaacagaggaccagctcactcccaagaaggcacagacagagcgcagccgccttcgcagcagcttggaagcggacaaggcagttcttggcgctaaaggatgtggcacctcctccactggctgtccacctgcccttgtccctgtccctgtccctacccctgccactgccaatgtcactccaactcaaagtccactctcccgtttttaccttactgaaaataacccgggaggggttctccccaatatgcttagtattgaagtttaaaaattaaaagcccaaccttctcttcctccggataccccacttagcttttcttttgaatagcattttggcgctctatgttgatttaagcgcggcccggctaaacagatgccagggccagggaagcgaatgcgaatctgtaagatagctaacagtgcacttaaaggaaaggggcgtctcgttcttgttctcttctttatcatacatcaaccaaggtttttatatcaaaccaaagggaaatactctgctagaatatggactgttgaagtcaccaaactgtgattattgattctgtacataccattgttattaaaaaaaaaaagaacagagctttgtatatttgaaatgttataacgcaattgcactcagcgtggtatggtaaaagtttgtcctcctgtagattcttactgtgttgtagatacggtagggttcctagacaaatatttatgtactcaagccctttatttaacttattaactgtagaggcttcggaaaccttcaagataaaggcaatggtacagtacttttgtgtaatgtgtaattgttatcacttttccttgctatctagtggagaagtgtcacgctcaaaataaaaaaaaaatatatgtttaacaaaaaaaaaaaaaaaaaaaaaaaaaaaaaaaa

SEQ ID NO: 188 - DNA, 2861 bp, Rattus norvegicus
ctgagcgcggagaggacgagctccggctgaggtcagagtgggagcccgcatccgaggggggcagaaaggaacaaagatcgcagtaatacctgttataatcagcaatctaacccatccccaacacacactctttcaccctaccggccaggagaggcaggcagaggtccactctgagcccaaggaaaaagctccaaccatgagcaatcagtaccaggaagagggctgctctgagaggcccgagtgcaagagtaaatcgccaactttgctctcctcctactgcatcgacagcatcctgggccggagaagcccgtgcaaaatgaggcttctgggagccgcgcagagcttgcctgccccgctggccagccgtactgaccaagaaaaagccatgcaaggctcccccaagggcagcagcgccccgttcgaggctgagctgcacctgccacccaagctgcggcgcctgtacggcccgggcgggggccgcctcctccagggcgcagcagcggcggcagcggcggcggccgcggcggcggcggcggcagccacggccactggcaccgcaggtccccgtggagaggttcctccaccgccaccgccagcagcacggccaggggagcgtcaggacagcgcgggggccgtggccgccgccgccgccgctgcctgggacacgctcaaaattagccaggcaccgcaggtgagcatcagccgcagcaagtcgtaccgcgagaacggggcgcccttcgtgccaccgccgcccgccctggacgagctgggtggtccggggggcgtcgcgcacccagaggagcgcctcagcgcggccagcggacccggcagtgccccggcggcgggtggtggcacgggcaccgaggaggacgaggaggagctgttggaggatgaggaagatgaagatgaggaagaggagctgctggaggacgacgaggaggagctgctggaagacgatgcccgcgcgctactcaaggagccccggcgctgctctgtggccaccactggcacggtggccgccgccgccgccgccgccgctgccgccgccgccgtggccaccgagggcggggagctgtcgcccaaggaagagctgttgctgcacccggaggacgccgagggcaaggatggtgaggacagcgtgtgcctgtccgccggcagcgactccgaggaggggctcctgaagcgcaaacagaggcgttaccgcaccacgttcaccagttaccagctggaggaactggagcgggctttccagaagacacactaccctgacgtcttcaccagggaggagctggccatgaggctggacctgactgaggcccgagtccaggtgtggttccagaaccgcagggccaagtggcgcaagcgggagaaggctggcgcgcagacccaccccccggggctgccctttcccgggccactctcggctacccaccctctcagcccctacctggacgccagcccctttcccccgcatcacccagcgcttgactcggcctggaccgccgccgctgcagcggctgcagctgccttcccgagcctacctccgcccccgggctctgctagcctgccgcccagcggggcgccgctgggcctgagcactttcctgggagcagccgtgttccggcacccggccttcatcagcccagcatttggcaggctcttttccactatggcccccctgaccagcgcgtcgaccgcggctgcgctcctgagacagcccacacccgcagtggagggcgcagtggcctcgggcgcgctggccgatcccgccaccgctgcggcagacagacgcgcatcgagcatagcggcgctgaggctcaaggctaaggagcacgccgcgcagctcacgcagctcaacatcctcccgggcaccagcacggggaaggaggtgtgctaaaggctgccctccgcccttgcgcccctagggcgcgccccgaaaggtcacctcactcagcaccactcaagaccaaatggaaacagaggaccagctcactcccaagacggcaaagacagagcgcagccgccttcgcagcagcctggaccctggacgcggacaaggcagctcttggcgctaaaggacgtggcacctcttccgttggctgtccatttgcccttgtccctgtccctacccctgccactgccaacgtcactccaactcaaatgtccacgctcccgtttttatcttactgaaaacaagcgggagggtttctccccaatatgcctagtattgaagttttaaaaattaaaagcccaaccttctcttcctccggataccccacttagcttttcttttgaatagcattttggcgctctaagttgatttaagcgcggcccggctagacagacaccagggccagggaagcgaatacgaatctgtaagatagctaacagtgcacttaaaggaaaggggcgtctcgttcttgttctcttctttatcatacaccaaccaaggtttttatatcaaaccaaagggaaatactctgctagaatatggactgttgaagtcaccaaactgtgattattgattctgtacataccattgttattaaaaaaaaaagaacagagctttgtatatttgaaatgttataacgcaattgcactcagcgtggtatggtaaaagtttgtcctcctgtagattcttactgtgttgtagatatggtagggttcctagacaaatatttatgtactcaagccctttatttaacttattaactgtagaggcttcggaaaccttcaagataaaggcaatggtacagtacttttgtgtaatgtgtaattgttatcacttttccttgctatctagtggagaagtgtcacgctcaaaataaaaaaaaatatatgtttaacaaaaaaaaaaaaaa

SEQ ID NO: 189 - DNA, 9406 bp, Homo sapiens
cttatttcttatgaatgtcggatagctgcaccagcttggtggggaaagggtttgatgaatagcacaaagacactggctgttccctggaggctgtccctttaaaggagaatcttagtttattctggggggaggggatgcacacattagagtaggaaagagggcttggaataaaatgaaaacactcccccttcatagtcattgtactgaaatgcaaagactgcttcctaagctggagatgctaaccttgggtagctccttctgttctcttcaaggggaattttgtcaggctatggattcatttacaactgttagtcatgtgggcatgtgtgaggaaacagatgccagttttaatgtatttagcccgaagttccaatttgataggagccactgtcagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 190 - DNA, 9122 bp, Homo sapiens
cacaaggcaaagcctgctctctctgtctctctgtctcctcttctccttttttgccttattctatccgattttttccctaagcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 191 - DNA, 9069 bp, Homo sapiens
tttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcaggtaacgaccaagacgcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 192 - DNA, 9054 bp, Homo sapiens
tttctttctctcagcatctccacccaaccagcagaaaaccggtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaaaggaggggagagtgctcagagtccagagtacaaatccaagcctatcattgtagtagggtacttctgctcaagtgtccaacagggctattggtgctttcaagtttttattttgttgttgttgttattttgaaaaacacattgtaatatgttgggtttattttcctgtgatttctcctctgggccactgatccacagttaccaattatgagagatagattgataaccatcctttggggcagcattccagggatgcaaaatgtgctagtccatgacctttcaatggaaagcttaggtgcctgcgttatatttgccctgtctaattttgcccatacagtcttccttctgtagagggctgtttacatatacagcacttaaaatgtttgtgtgggaaaaaaaaaactcattggcagatccaagaatgacaaacacaagtgccccttttctctggatctcaagaatggtggaggaccctggaaggacagcaaggcagctccccagcctcactcttcactcctgattgaggcccgggtttgttgtccagcaccaattctggctgtcaatggggagaaataaaccaacaacttataattgtgacaccagatgcttaggatcctggtgctgggttagctaagagaatagacagaattggaaaatactgcagacatttccgaagagtttataaagcacagtgaattcctggtcaatctctccactgaggcaatttggaatcaataagcaattgataatagtttggagtaagggacttcatatacctgattcctctagaaggctgtctaacataccacatgattacatgaactgtatggtatccatctatctctgttctattgaatgccttgttaacagccaacactgaaaacactgtgagaatttgttttcaggtctgacacctttcagtctctttttatagcaagaaatcaatatcctttttataaaaattcatgtctgtatttcaggagcaaactcttcaggctccttttttataaactggtgatttttcttttgtctaaaaaacacatgaagaaaatttaccaaaaaaaaaaaaaaaagcagaagaataatgtagtttagaaattatgctgtcactgccaaacagtaacctccaggagaaaacaagatgaatagcagaggccaattcaatagaatcagttttttgatagctttttaacagttatgcttgcattaataatttcaatgtggaccagacattctaattatattttaaatgaaatgttacagcatattttaagcaactctttttatctataatcctaatatttcatactgaagacacagaaatctttcacttgtctttaacattagaaaggatttctctttactaaggactgatcatttgaaatagttttcagtcttttgagatacaggtttataacactgcttttttttttctgtaatcatagcccataatggcaaagacaactaaatttaagtgaaggtcatgcatgccaattctgtgtttgcttttagcagatatgaagatttccttatttctttgtaattgtgcagatattttgaaaggcacagcattcgaagccaagctgctgtttggctactgaatggcttgcagttgttcctccactctaaatggaatgagcttgctgtgtgtgtgtgtggtggtggtgggagggggtggtgcatgtgtgtgtgtgtgtgtgcatctgcagctgcttcaaaattaggaaatactacaggacacccctgtaatggattggtggcaactgggtggcactgctgatgtgcactgtgtaggggggaacccagtggtggtggggtagctcagatgcccctagacaagcttcagatgtctgtagctaccagaaacattttcggttcaggaaaagtgagatgatggtagtactggtttctggtgaaattgaagaaccccaaatgatgaggatctctttttgccccctctcctttttttgtagacccattcaaaaccattaataagcccattttactaagcccctatttctttctagaagctcagggttttcttagtgcctcccagaacattttgtagttaattgggaaaaagtgatacttggattagggggtgtgggcataaagaatggtgggaggcctgattttaaacttcaggccagaacccccaatgactccacccatagtctcactttaggtctcatttagtccatcacctttattttaagttgaggaagtggaggctggtaaagagcaggaccagaggaagaatccagatttccttatgcttgggcctcacactagctctctgagtatttccttgattgcggtatatgtactactagaaaataccaaatggatatattttctttaggataacctttgaaccaacaatcttcaataacaatagtacatcttccatcttacttttaatcgagtataaggaaatgtttctttatggccattttggagggagcaggggatgaggcttggcatagtccaaaatttaagtctccaataattaattgcattttaaattggcccactttcaaggcaattttttttgtgtgtctgtaactgagctcctccacccctgtcattcacttccaattttacccaatccaattttagcactcaagttccattgtgttaatttctgcacggtcaacaaacatcaagtcagcaagcatttgccaccactccctatacttctccctccttcttacacacacacacacacacacacacacaatccatctcttgcttgttcctacctcctgatttttcttccctacagaaatagaaatagggacaaagaaggggaaaatgtatatattggggctgggctgaacaactaacttcataagtagtattaactaggggtaaattgagagaaaagctccttttctcttcactgttttggaaaggatagccattagcatgactgctttgtgtccttatggactttagtattagcctagattgaattatagcgttttctagctggaaggaaccttaagatcacatcatctactcctctactccaaatttctcattcttcaggccaggaaaccgagacacagaggtaaagtaatttccccaaggtcacacagctggctggggcaggattgggtttacaacccacatctcctggctcttattccagggccttttcccactaagtagtattgccttccattaggctcctgagagttatttctcagggtcatgttgcatcttggagccacatgctgctgccctgatctcagtgggaaatccacccagcaacctaatacagccccttttccctgcattcacctggttcccatccacatgggttgcagatgtccttgaagagagtgaggcattgagggccaataggagcaatggggtccctggccttgtccatctgattcaggagatcactgctccatcgtgaggagccctctgaatagccccccactgaatgcttgccttgcccaaatggaatggaggaagattgattttctccatcagttcaccttgtgtcatctcataatggttggtctttccaggctgagggaaatgtttcttgtttccagagtagaaaaagaaagagtggaacaatagctttgttcatcctaactttctgagatggcttttcaacattttaaaaaaactagtgtggctaccattcactggcaatgatttcttttagaatatgggagtaagatgagctagagaaaataacctggtctcactgtggttgccctcatccacaatgtccccaaagccatcctgctctgatgaggacaatttccaggtataagcaaggggctttgtgacaaaaatgtaccctggctgatgttaaacattggctcctgtgtttgcaccaaaatagcaagctgtgtgctctatacactcttcccatcgtcttgtgtacactgctcctgtggccttccacagcagaaaccagggcaaaagggtccaaacacatggttttccttgctgcaaggctcttcctgggaactaagggggtatttattagttcagttctaagagacctccttctgggcttaccccactcctcaggtacttctctctccttcctccttctcctccacagtcacaagtaaccaaggaacctgaaagtggatgtgtagctatttgaagaaggcaaggaaccctgagattcttctttgaatcctctagtccaagtcttagaccagtgattggtgcttaccttgaacaaaattttgtctgtgttcctaatcccttcaatactctgggtacaatgctcccaatcaccctgcacatttgattctaaatggcttttattttttaaaaatccatatccctaggacaagagaacaggatgcctatatccccaaaatgagctccaggacactgatgggaatgatcccaaagatcaccccacctcagaaacgtctgtgccaagagacttccccagatagaaacactgggacagtggtttgaacgacttcttttatggttgtccagtttgctatggaaataaaaggcattgattttttaaaaagatgattggaacctgtctttggccacatagggccacttggatccatttccaggccttactcatatattgccttcactgaagggctttggctttaagtcccagactggtctcccaagtgaaccataagtgttttggagctcatctggggtgaggcatgagaatgttgccccatctatcccttcaggaaaaggtgccttccctccctttctcctaaagcctggtccccagaaattgtttttgtctccaaaagtctagtatggtctttatacacccagactcttagtgttgcgtcctgccttgtttccttgttaaggatctatgcagacctcccgctttggcttagctagcgtgacattggctatcatttgacaagactaacttttttttttttttttttttgactgagtctccctctgtcacctaggctggagtgcagtggcacaatcttggctcgctgcaaccttcacccttcacctcccaggtcgaagcgattctcctgcctcagtctcccgagtagctgggattacaggcgtgcgccaccaaatctggctatttttttattattattatttttagtagagatggggtttcaccatgttggccagactggtcttgaactcttggcctcaaattatctgcccacctcggcctcccaaagtgctgggattacaggcatgagccaccatgcccagctgacaagactaattttttatcccttggtttattggcttcaacatcttctggaatcagaggtgattttttcttaccttggatgcctgagactaggggagtatagaattccaattggtaattaaggcatctttctgctcctgatcagaagggcaggttagttgggagaggtcagatggcacaacagaagtcaccttgtaagtaaggcaaagacttgaaggcattagcgtttctcattactaggtcaataacctgagggaatcaatggctttttgccgctctacctcttgtgtatctctttgacttttctttctctgtctagtttcctctgttctcagtttatattctatgttatcagtctctctttccacagtacaaacatccatcctttctcctgtgcaattctgtctctccctcttattatctttatttgtactttttccttcctccctgtctaggcattgggcatgtgcctcttcttagcctgtgattttgccttgggactgatgataaattatttccagattcaatcagccctggtcctaccccagtccaatcagaagtatgttggtgggaatcaacctgatcctggccctttcttcttctccattttcattcgtaatccccctcagcagatctttacaagcagtttccttatagctcatgtatctttaggtctttgccttccaagcactgtacagaatactttgtggttcctttttagtctgacattttgtggagcagtgaagcgtgctcagagacataatcagctgaagagaaaaaatccacccatggatttatatcagctaaatactaataattgattttgtttgatgtgcccataatttttaaagctgcaatataatataatgagggaccacaggtaatttctcctgtcatttgttttggctggatgggggtgggggagtaattgcttaaagttttaccattacacattaaactctctataataatcttgtttggggcttgctaactgttgagctgttttaactaaactggtaggcaatcggagttgatttaaatgaaaagataatttaacaaatctatactataaaaagagacatttgcttaattgacatgtattttttccttctgagtcacctaaacatttactcttgacaccaactgttcatgatactgaatagacagtccatataagagaaattagtggacctaaagaagccagattgtaggtgttaatttattaaacagagtgcaaagcccttggaaatgtcactgcttggcaataccatatggaatgccaaaatttacaatgacttttctttataagttatccaaaagggatttgaacaagtaagaggttatgccaaaatgtctccaatgtatggtcctgtaatatattgcagcttgaagccaatgatcccttatgacttgtatacaactaatgcatgttttattgaattttgcatttcccacgtgtggtaagttctttaaaatgtttttgatcacctttttgtgccattaaacttgtacagaaaatgtttttatggccattttcaaagggagaaagtttaaaatggaaacagcccaccctttctgccctatagctgtagttagaattgagtacctgtagcaaaacagctgtaattggtggttgtagtgttagaggtgttagcttgctagtgactagctttggagagtaaatgcatggtattgtacatcacatttcttaactcgttttaacctctgaaaagaatatattcttctttgtagtccttcttcccacccccttgccctctccctctccctgctcccagttgtcttacagttgtaaatatctgatttgaggcccaataactcttgccaagtaaagtcagcaaacaacaaacaaaccaaaatgtggggaaaaggcatttctcaaccatctctcagcagttattgatcatttcttaaggaacagcattgtgatcaaagactcaactttacgtaaaaatcagtggtaaattggggttgtatttggccatttgattacatttcaggattgaatagttttcagaatcacatgtaatccaaagacagtaggtagtgatgtcccttatccctgcagctgttttaagatagagacctcagaagactctgcttgaccgatgaccaataattatttgaaaaaaaaagaaaaaatgagagaaataaaacagatatttaagaactttagccacctatttagaatagttatagccagaaaaaaaaacaagggcatgagttcaaatgcattactatcagtgtcctaggcaatacctaacctactctgaaattgtgattcaaaagcagtatttcaagaggcattctccttttttggtttgctgaccccacttggactggtaggtttggtgaggcccccataaaccagctggagcagacccttttcatctcctgtgcctgtaacacccctcttcccccaccccctccgcaattcaatgagggctttcttgggtcagaggacttcaaggttgtctagagaagtttgccatgtgtgtaaggtgctgtgaactgtgagtgctgaagattcgcagcattcaataccaggcagccaaagagctgctcttgcaattattttggctctcaagctctgttcttcatcgcattctcatttctgtgtacatttgcaagatgtgtgtaatgtcattttccaaaaataaaatttgatttcaata

SEQ ID NO: 193 - DNA, 1308 bp, Pan troglodytes
atgcatagtcctgtgctatctcttttcctcaatgagtcatcaagcccctcaggggcagtgatggatgtttcctacactgtcttgcctgtggtacagggcacatgctcagacaacaaaggcatagagagattggttttctttctctcagcatctccacccaaccagcagaaaaccgcttctacctgggattttcctttggaaaagtctctgaggttccaccaaaatatggaacttgattttggacactttgacgaaagagataagacatccaggaacatgcgaggctcccggatgaatgggttgcctagccccactcacagcgcccactgtagcttctaccgaaccagaaccttgcaggcactgagtaatgagaagaaagccaagaaggtacgtttctaccgcaatggggaccgctacttcaaggggattgtgtacgctgtgtcctctgaccgttttcgcagctttgacgccttgctggctgacctgacgcgatctctgtctgacaacatcaacctgcctcagggagtgcgttacatttacaccattgatggatccaggaagatcggaagcatggatgaactggaggaaggggaaagctatgtctgttcctcagacaacttctttaaaaaggtggagtacaccaagaatgtcaatcccaactggtctgtcaacgtaaaaacatctgccaatatgaaagccccccagtccttggctagcagcaacagtgcacaggccagggagaacaaggactttgtgcgccccaagctggttaccatcatccgcagtggggtgaagcctcggaaggctgtgcgtgtgcttctgaacaagaagacagcccactcttttgagcaagtcctcactgatatcacagaagccatcaaactggagaccggggttgtcaaaaaactctacactctggatggaaaacaggtaacttgtctccatgatttctttggtgatgatgatgtgtttattgcctgtggtcctgaaaaatttcgctatgctcaggatgatttttctctggatgaaaatgaatgccgagtcatgaagggaaacccatcagccacagctggcccaaaggcatccccaacacctcagaagacttcagccaagagccctggtcctatgcgccgaagcaagtctccagctgactcagcaaacggaacctccagcagccagctctctacccccaagtctaagcagtctcccatctctacgcccaccagtcctggcagcctccggaagcacaaggacctgtacctgcctctgtccttggatgactcggactcgcttggtgattccatgtaa

SEQ ID NO: 194 - DNA, 1254 bp, Canis lupus
atggagtcacggtcgttcaagacaccacctattaatacgagtagtctcagttttgaggatggaatttcttgcttggagctcagacaacaaaggcatagagagattggttttctttctctcagcatctccacccaaacagcagaaaaccggtctctgaggttccaccaaaatatggaacttgattttggacattttgacgaaagagataagacatccaggaacatgcggggctcacggatgaatgggctgccgagccccactcacagcgcgcattgtagcttctaccgaacccgaaccttgcaagctcttagcaacgagaagaaagccaagaaggtacgtttctaccgcaatggggaccgctacttcaaggggattgtgtacgctgtgtcctctgaccgttttcgcagcttcgatgccttgctggctgacctgactcgatctctgtctgacaacatcaacctgcctcagggagtgcgttacatttacaccattgatggatccaggaaaatcggaagcatggatgaactggaggaaggggaaagctatgtttgttcctcagacaacttctttaaaaaggtggagtacaccaagaatgtcaatcccaactggtctgtcaatgtgaaaacatctgccaatatgaaagccccccaatccctggcaagcagcaatagtgcccaggccagagagaacaaggactttgtgcgccccaagctagtgacgatcatccgcagtggggtgaagcctcggaaggccgtacgtgtgctgctgaacaagaagacggctcactcttttgagcaagtcctcaccgatatcactgaagccatcaagctggagactggggttgtcaaaaaactctacactctggatggaaaacaggtaacctgtctccatgatttctttggggatgatgatgtgtttattgcctgtggtcctgaaaaatttcgctatgcgcaggatgacttttctctggatgaaaatgaatgtcgagtcatgaagggaaacccatcggccaccgctggcccaaaggcatctccaactcctcagaagagttcagctaagagtcctggccctatgcgccggagcaagtctccagctgactcagcaaacgggacctccagcagccagctctctacccccaagtctaaacagtcacccatctccacgcccaccagtcctggcagcctccggaagcacaaggatctgtacctgcctctgtccttggatgattcggactcacttggtgattccatgtga

SEQ ID NO: 195 - DNA, 9078 bp, Mus musculus
atagagagattggttttctttctctcagcatctccacccaaccagcagaaaaccggtgagtggggctttcgagtgattttcaagcagaatgtaacagatgtcaaccgggaaagcacaaggcacacggctttctttctctgtgtgttcgcctctttcttctcttttatttgccttattctataggatttttgtcctctaagattctacctgggattttcctttggaaaagttgctgtggttccaccaaaatatggaacttgattttggacattttgacgaacgagacaaagcatctagaaatatgagagggtcacggatgaatggacttccaagtcccactcatagtgcccactgtagcttctacagaaccagaaccttgcaggcattaagtaatgagaagaaggccaagaaggtacgtttctaccgcaatggggaccgttacttcaaggggattgtgtacgctgtttcttctgaccgttttcgtagttttgatgcgttgctggctgacctgacccgatccttgtctgacaacattaacctgcctcagggagtgcgctacatttataccattgacggatccaggaagattggaagcatggatgaactggaagaaggggaaagctatgtctgctcctcagacaacttctttaaaaaggttgagtacaccaagaatgtcaaccccaactggtctgtcaacgtaaagacatctgccaacatgaaagccccccagtccttggctagcagcaacagtgctcaagccagagagaacaaggactttgtgcgccccaaacttgtgaccatcattcgcagcggggtgaagccacggaaggctgtgcgcgtgcttctcaacaagaaaacagcccactctttcgagcaggtcctgactgacatcacagaagcgatcaaactggaaaccggagttgtcaaaaaactctacacccttgatggaaagcaggtcacctgtctccatgatttctttggtgatgatgatgtgttcattgcttgtggtcctgaaaaattccgctatgctcaagatgatttctccttggatgagaatgaatgcagagtcatgaaagggaatccatctgccgcagctggcccaaaggcttccccaacacctcaaaagacatctgctaaaagcccaggcccaatgcgccgcagcaagtctccagctgactcaggtaacgaccaagacgcaaatggaacttccagcagtcagctctcaacacctaagtcaaagcagtctcctatctctacacccacaagccctggaagtctgcggaagcacaaggtagacctgtacctgccgctgtcattggatgactctgattcacttggcgattccatgtgaaagatgataggctaaatcaaagcctattattgtagcagaatactttcgctcaagtgaccaacaaggctattggtgcttaaacatttttgttattgttgcttttcaaaacactctgtagtatgtagggtttattttcttgtgacttctcttctgggccactaattcacatttaccaataagagatagattgataaccatccttttgagtgacttttccagaacttcaaagtgtgctactccatgacctttctactgaatgcttaggggcctttgtattttccccactcaatttgttcagaaactagtcttccttctctggaaggctgtttacatacacatcacttaaaatgtttatgtgtggggaaaactttcatatgcagatctaaaagcgaaaaacctaagtgtcccttgcctctgtatcttcagaatgctggaggatctcaggagagtggcaagtcagatccttggtctcactctttgctcttaattgagcccccagtgtattgtctagcattcatcctggctgttgagatggagaaacaccagcgacttttgatgtgacaccatgtgcttagggctgtggtatagggctgtctgaaagatatgaggtagaatatagggggaaaactgcccaaatttcagtaggatttgtataaagcacagtggattcctggttaacccctctactggggaaatttggaatcaatcaattgattagtttggggtacatgatgtcacatacatgatccttccaggaggctttctaatgtacaagttagtacatgaacggtatggtatccatctagctctgttctattgaatgccttgtaaacaaccaacactacaaacactgtgagaatttgttttcaggtctgacaccttttggtcgctttttatagcaagaaaccatatccttttttataaaaaactcaactctgtatttcaggagcaaaactcttcaggctccttttttataagctggtgatttttttcctttgtctaaaaaacacaagtagaaaattgaccaaaaaaatgcagaagaatactgtagtttagaaatcatgctctcactgccaaacagaaagctccgggagaaaacacaatgactagaggccaattcaatagaatcaggtttttgatacctttttaacagttacacttacagtaataatttcaatgtggaccagacattctagttatattttaaatgaaatgttatggcatattttaagtaactcttttttatctataatcctaatatttcatacttaagatgcagaaacctttcacttgactttaacattaggaaggacttctctttattacggattgatcacttgaaataactctgtctttgaggtacaggtttataacattgctttttctctgtattcatagcccataatagccaagacaacgaaagttaggtgaaagccatgcatgccaattctgtgtttgatttgacgagataggaagatttccttcacttctttgtaattgttcagatagtttgaaagatgcagcattcaaagtttggctgctgaatgacatgcagttgtccctccattctaagtagaatgagtgtggggttcatttgtgtgtgtgtgtgtgtgtgtgtgtgtgtgtgtgtgtgtgctcgcgcgcgcatgcgcaagcacgcctaggctgcttcatacttagcaaatactgcacaagacaactcaacatgaattgatgacaacttggtggcattgctgatgtgcagggggaagtaggatggcaggggtacctagagcccccttgataaatttcagatgtccttaattatgagattccaagaaacatttttgcttttggttcagcagaagggggatgatgagagctctggtttctgcttacactgctcattgaagagcccaaaatcatgaggttttgctccccccccctttattgctatgcccacatgaaatgattaagaaacccattttaatcggcccctatttttttttctacaagctcagtgatttcttagtgcctcccagaacatttgagttaattagggaaaattggttatttgggatggatagaaattgtggtaggagatctatttttaacctctgggccagatcctccagcacactctatgttgttctttgagcaaatcccatgttgtcccaagtattcatttaagatgagacatggagattctactgaaagagtgggagcaaagaaatttcaacagtccctatgcccaggcttcttggtagttctctgagcatttttctacttgtagtataatatagcactagaaaatactatggacatatcttttttagaatattcttagaacagacattcttgtataacaacagtgtcctttctgtttttctttgtgctaactacaagtaaacctttaacaaatacttttcctttatatacaggcacagatacatacatataagaaaacttttttttactgctacttcgtgtggcaagggttggtaaaattgaaaactcaagtctccaataatttagttttaaattggctcaaattcaagtaatttttttcagaactaagctcttacatcccccgtattctttctcagtttttcctaatccacttttaccactttagtcccatcaagttcagcgtgcatggtcagcaagcatttgccactattttccataacaccccctctctctttttccctcctcctccctccttctctctctctctctctctctctctctctctctctctcacacacacacacacacacacacacaaagaatatgttgcttgttcctacctcctgactgttcttccccacagaaatagaaataggggcaaaaaaaaaaaagggaaatgtatatataggggctgggttgaacaactaacttcgtaagtagtgctaagtataattaaagtgagagaaaagctccttttctcataattgttttggaaaggatagccattagcatgactgctttgtgtccttgtggactttagtattagcctagactgaattatagcattttctagctggaaagaggattaagatctcatcatctgctcccaatttttcattttcttaaggccaggaaacagacaaagacataaagtgatttccccctaaggtcacacagctgcccattggcagtgctgggattagaacctacacctcttggctcttattccaatttttttcccccaactagtgagtattgtcctttgtgaggctcctgcaaattctttcccagggtcatgttgcaccctggatccatatgctactttgttggtctcagcaagaaatccacacagcaatataatctggcccttcctcctcactttcacattacttcatccacatggcctgcagacagttccaaggagagggaggcattgagacgttgagcaccagagggttgctgccctaccttgaggaatcttccaaatagctcgctgaactccactctattcatggagaatggaaaatgactactttgtcccttatcagcttccttcaaggtcatgtcacacgtgttcctcccaggataggggagtgatttccagagcacagaaaattagaagtgaataacagagtaatagctttgtttattctgactttctaaagatgacttttttttagccatttaaaaaattagtctggctatctttactactaataacaatttcctttaaaatatggcagtgagccaagccagagaaagataatcaagtcttgtgtttatcctcaatctctacgcccttgtagccatgctccctggtacaaacaattttcaggtataaacaagtgtcttttgtcactaaattgtgccctggctgacactgaatatttgtatctataccaaaaatagcatacagtgaccttacacattatattctctctctctctctctctctctctctctctctctctctctctctctgtgtagcctgtttctgtgctttccatgacagaagttagggcaacatgatctgtatgtgtaggtttctttgcagcaaggctttcctggaactaatgaatattcactgaattctagaagatctcttactaaatttacccaagttcaggaacttctctatcttttcttccctccatctgggagtgaccaaggaattgtaaagtgggtaggtagcttccatgtcctagaatcatcaagcctaagttgaaggcaaatgactcaatgcttgatttgcataaacttgtgtccccatgcccagtctctccaatagtctacatagagatttccccatttcctctcacatttgactccaaatggatttttcctttagaaaacagggaaggaaataagccctatctccttagaatgggagcgatcacacacccatgggtccccaatgagcttctgtgatggtgagaatgttgcaagagatgagactgccttgggaacagttgtatcaagagacttctctagcagaaacccaatgacagcatagctttacggacttccttcatggtctagtttgctatggaaatagaaaacataggatctttctcttttctttctttttttttcttctttttgaaacaatgcttggatcctgttcttgggcacatggggccatttggacccatacctaggcctcagttatatattgccttcattatattaagacgtttaggcttctaggctcaaattagttttctaaacagagcaagggtactttggagctcatatgggtgcacaggaaggcctatgtcctatgatttagatctggaaccatgggatggtaaaggctgtatagtgacctagtcatttagagtatgtcaggtataatgtgttagaagctcatgcttctgcctctgcccttctaaaaccacgtgtgtcgtgccactcactgttacgtgaatcctgaaggatttcctcttctttcaaacatgaccacctggagcaagaataggtcactgactttttgtgctttctttttgattagagagacctctatctcccttggatgcataaatgaagtttcattagccatcacaccaagggcttcttagtgttgattaatgtggagctcatgttttggccaaactggtgtgagattggctatcattgggaagtgaagtatttcttaactttactggagtcaaaaatcttctgaaattagaagtgatttttttttctatctggcatacctggggctagggaagtagagaattctcagttgaaagtaaggcactttcctacttggattacaagagcagttgagttgaaaaaggtcaaagagaacagagaagtcagaagaccaagtcttgtaaactaaaacaaagacccgaagcttcagaatgtctcgattttgggcaataactcaaggaaataaatggctttttgtcattccatttcctgttttctttctctatttagatgcctatatttgttctcagttatcagtctctcattcggtagcaaaaacatccattctttgacttgtgaggtacttcctcctcttttggaatccgttgcttcttcccacctcactactgggtataagcttcttcatagtctgtaagttttaccttgggattgaagagaaattattttctgtttcaaaaattcctggttctacccctgttcagtcacaagtaggttggtagaaaacaacctgattctgaccctttctttttttttttcctgttttagtctcagtagatcttttcaagcactgtccttacagctcatgaatgtttaggtctttatcttctaagcaagcattgtacagaacacgttgtgcttcttctttttgtctgccattttgtgaacggtgtaatgtgctcagataaataatcagctgagcaggaaaagagtctactcatctattcaaattggcaaaccattgtttagtttgtatcattaaatttgctcatagcttcgaaaagctgcaatataatgtcatgagagaccacaggtaattgttcctgtcatttggttgggcttagtggagatgggggtgggcaggaacaatttgtttaaacttttaacgctattcattaagctctctgttataacattatgatctgtgatcttggccacctgtcgaactgtttaagctaaactagtgggcaattaaagttaatttaagtaaaaaattatctaacaaatccaggctacagaaaaaaaaaaaaacttagttaaatgtatttgtccttacgatactagatttacctaaacattttccttttaacaccaactgttcacgatccaggactgcctgtccatgtatcaataatgagcagtcttaagtctgctaattaattcagaaaccttggggatgtcaatgtcactgcttggcagtaccatatgcattgcccatttttccagtaacttttctttctaagttctcttaaagacttttgagaaagtaagaagctaagtgaacatatatccaatgttttgtaatgtattatattgcagcattaagtcaacaaccccttatgacgtgtacccagctaatgcatggtttcagagtggattttgcatttttcatgtgcagtaaatgatttaaaaatgtttttggtcacctttttgtgccattaaacttgtacagaaaatgcttttatggccattttcaatgggagaaagttaaaaaatggaaacagcccaccctttctgccctatagctgtagttagaattgagtacatgtagaaatacggctgtaattggtggttgtagtgttatagttgttagcttgctagtgactgcctttggagagtaaatgcatggtcttgtacatcacatttcttaaataactcattttaacctctgaaaaggatatattattccatgtggccctcttccctccctccattccctgctcccagatatcttaccattaactgtaaatacctgatttaggggccaagagtttctgccaagtaaagttagcaaggagcaaataacccaaaaggggtgaagagaatttcacaacaatttctcagaagttattgaccctttctcaaggaatggcatggttatcaaagactcagctgtcttttacataaaaatcagaggcaaattgggagtgtctttggctgccagattacagaattgaaaaattcttagaatcatacaacccaaggatgtccctgatccctgcattacttgtgaggcatttggagacatcagagatttgctgactaatatttattggggataaaaagaaaagcaaaacagagatgtgcgacagatactcaggggtttcagctaggctccagtcagcaaaggtaaggatgtgggtttagatgcattgttatctgtttcccaggcaatgcttaacacactcttagtgctttgagtgatacaaaggcagtgtttcaacaagacactctcttctttggtttgctgttctctcttggactggaatgtttggcaaggcccatgtaaactggttagagcaggccctttatatctcctgtgaccgttaatctcccccaccataatttgatgagggctgtttggtttgaggacttcaaggatgtctagagaagttcccccatgtgtgtgaggtgttgtgaactgtgaacactgtacatcttcagtgttcaatactgggcagccaaagagctgctcttgcaatctttttttggctctcaagctctgttctccatcgaattctcatttctgtgtacatttgcaagatgtgtgtaatgtcattttccaaaaataaaatttgatttcaataaaaaaaaaaaaaaaaaaa

SEQ ID NO: 196 - DNA, 9000 bp, Mus musculus
agttacaggggagaagctggacaaggcactaggacctagaaggcaactatccaccctggcaggaatttcttgcttggagctcagacaacaaaggcatagagagattggttttctttctctcagcatctccacccaaccagcagaaaaccggttgctgtggttccaccaaaatatggaacttgattttggacattttgacgaacgagacaaagcatctagaaatatgagagggtcacggatgaatggacttccaagtcccactcatagtgcccactgtagcttctacagaaccagaaccttgcaggcattaagtaatgagaagaaggccaagaaggtacgtttctaccgcaatggggaccgttacttcaaggggattgtgtacgctgtttcttctgaccgttttcgtagttttgatgcgttgctggctgacctgacccgatccttgtctgacaacattaacctgcctcagggagtgcgctacatttataccattgacggatccaggaagattggaagcatggatgaactggaagaaggggaaagctatgtctgctcctcagacaacttctttaaaaaggttgagtacaccaagaatgtcaaccccaactggtctgtcaacgtaaagacatctgccaacatgaaagccccccagtccttggctagcagcaacagtgctcaagccagagagaacaaggactttgtgcgccccaaacttgtgaccatcattcgcagcggggtgaagccacggaaggctgtgcgcgtgcttctcaacaagaaaacagcccactctttcgagcaggtcctgactgacatcacagaagcgatcaaactggaaaccggagttgtcaaaaaactctacacccttgatggaaagcaggtcacctgtctccatgatttctttggtgatgatgatgtgttcattgcttgtggtcctgaaaaattccgctatgctcaagatgatttctccttggatgagaatgaatgcagagtcatgaaagggaatccatctgccgcagctggcccaaaggcttccccaacacctcaaaagacatctgctaaaagcccaggcccaatgcgccgcagcaagtctccagctgactcaggtaacgaccaagacgcaaatggaacttccagcagtcagctctcaacacctaagtcaaagcagtctcctatctctacacccacaagccctggaagtctgcggaagcacaaggtagacctgtacctgccgctgtcattggatgactctgattcacttggcgattccatgtgaaagatgataggctaaatcaaagcctattattgtagcagaatactttcgctcaagtgaccaacaaggctattggtgcttaaacatttttgttattgttgcttttcaaaacactctgtagtatgtagggtttattttcttgtgacttctcttctgggccactaattcacatttaccaataagagatagattgataaccatccttttgagtgacttttccagaacttcaaagtgtgctactccatgacctttctactgaatgcttaggggcctttgtattttccccactcaatttgttcagaaactagtcttccttctctggaaggctgtttacatacacatcacttaaaatgtttatgtgtggggaaaactttcatatgcagatctaaaagcgaaaaacctaagtgtcccttgcctctgtatcttcagaatgctggaggatctcaggagagtggcaagtcagatccttggtctcactctttgctcttaattgagcccccagtgtattgtctagcattcatcctggctgttgagatggagaaacaccagcgacttttgatgtgacaccatgtgcttagggctgtggtatagggctgtctgaaagatatgaggtagaatatagggggaaaactgcccaaatttcagtaggatttgtataaagcacagtggattcctggttaacccctctactggggaaatttggaatcaatcaattgattagtttggggtacatgatgtcacatacatgatccttccaggaggctttctaatgtacaagttagtacatgaacggtatggtatccatctagctctgttctattgaatgccttgtaaacaaccaacactacaaacactgtgagaatttgttttcaggtctgacaccttttggtcgctttttatagcaagaaaccatatccttttttataaaaaactcaactctgtatttcaggagcaaaactcttcaggctccttttttataagctggtgatttttttcctttgtctaaaaaacacaagtagaaaattgaccaaaaaaatgcagaagaatactgtagtttagaaatcatgctctcactgccaaacagaaagctccgggagaaaacacaatgactagaggccaattcaatagaatcaggtttttgatacctttttaacagttacacttacagtaataatttcaatgtggaccagacattctagttatattttaaatgaaatgttatggcatattttaagtaactcttttttatctataatcctaatatttcatacttaagatgcagaaacctttcacttgactttaacattaggaaggacttctctttattacggattgatcacttgaaataactctgtctttgaggtacaggtttataacattgctttttctctgtattcatagcccataatagccaagacaacgaaagttaggtgaaagccatgcatgccaattctgtgtttgatttgacgagataggaagatttccttcacttctttgtaattgttcagatagtttgaaagatgcagcattcaaagtttggctgctgaatgacatgcagttgtccctccattctaagtagaatgagtgtggggttcatttgtgtgtgtgtgtgtgtgtgtgtgtgtgtgtgtgtgtgtgctcgcgcgcgcatgcgcaagcacgcctaggctgcttcatacttagcaaatactgcacaagacaactcaacatgaattgatgacaacttggtggcattgctgatgtgcagggggaagtaggatggcaggggtacctagagcccccttgataaatttcagatgtccttaattatgagattccaagaaacatttttgcttttggttcagcagaagggggatgatgagagctctggtttctgcttacactgctcattgaagagcccaaaatcatgaggttttgctccccccccctttattgctatgcccacatgaaatgattaagaaacccattttaatcggcccctatttttttttctacaagctcagtgatttcttagtgcctcccagaacatttgagttaattagggaaaattggttatttgggatggatagaaattgtggtaggagatctatttttaacctctgggccagatcctccagcacactctatgttgttctttgagcaaatcccatgttgtcccaagtattcatttaagatgagacatggagattctactgaaagagtgggagcaaagaaatttcaacagtccctatgcccaggcttcttggtagttctctgagcatttttctacttgtagtataatatagcactagaaaatactatggacatatcttttttagaatattcttagaacagacattcttgtataacaacagtgtcctttctgtttttctttgtgctaactacaagtaaacctttaacaaatacttttcctttatatacaggcacagatacatacatataagaaaacttttttttactgctacttcgtgtggcaagggttggtaaaattgaaaactcaagtctccaataatttagttttaaattggctcaaattcaagtaatttttttcagaactaagctcttacatcccccgtattctttctcagtttttcctaatccacttttaccactttagtcccatcaagttcagcgtgcatggtcagcaagcatttgccactattttccataacaccccctctctctttttccctcctcctccctccttctctctctctctctctctctctctctctctctctctcacacacacacacacacacacacacaaagaatatgttgcttgttcctacctcctgactgttcttccccacagaaatagaaataggggcaaaaaaaaaaaagggaaatgtatatataggggctgggttgaacaactaacttcgtaagtagtgctaagtataattaaagtgagagaaaagctccttttctcataattgttttggaaaggatagccattagcatgactgctttgtgtccttgtggactttagtattagcctagactgaattatagcattttctagctggaaagaggattaagatctcatcatctgctcccaatttttcattttcttaaggccaggaaacagacaaagacataaagtgatttccccctaaggtcacacagctgcccattggcagtgctgggattagaacctacacctcttggctcttattccaatttttttcccccaactagtgagtattgtcctttgtgaggctcctgcaaattctttcccagggtcatgttgcaccctggatccatatgctactttgttggtctcagcaagaaatccacacagcaatataatctggcccttcctcctcactttcacattacttcatccacatggcctgcagacagttccaaggagagggaggcattgagacgttgagcaccagagggttgctgccctaccttgaggaatcttccaaatagctcgctgaactccactctattcatggagaatggaaaatgactactttgtcccttatcagcttccttcaaggtcatgtcacacgtgttcctcccaggataggggagtgatttccagagcacagaaaattagaagtgaataacagagtaatagctttgtttattctgactttctaaagatgacttttttttagccatttaaaaaattagtctggctatctttactactaataacaatttcctttaaaatatggcagtgagccaagccagagaaagataatcaagtcttgtgtttatcctcaatctctacgcccttgtagccatgctccctggtacaaacaattttcaggtataaacaagtgtcttttgtcactaaattgtgccctggctgacactgaatatttgtatctataccaaaaatagcatacagtgaccttacacattatattctctctctctctctctctctctctctctctctctctctctctctctgtgtagcctgtttctgtgctttccatgacagaagttagggcaacatgatctgtatgtgtaggtttctttgcagcaaggctttcctggaactaatgaatattcactgaattctagaagatctcttactaaatttacccaagttcaggaacttctctatcttttcttccctccatctgggagtgaccaaggaattgtaaagtgggtaggtagcttccatgtcctagaatcatcaagcctaagttgaaggcaaatgactcaatgcttgatttgcataaacttgtgtccccatgcccagtctctccaatagtctacatagagatttccccatttcctctcacatttgactccaaatggatttttcctttagaaaacagggaaggaaataagccctatctccttagaatgggagcgatcacacacccatgggtccccaatgagcttctgtgatggtgagaatgttgcaagagatgagactgccttgggaacagttgtatcaagagacttctctagcagaaacccaatgacagcatagctttacggacttccttcatggtctagtttgctatggaaatagaaaacataggatctttctcttttctttctttttttttcttctttttgaaacaatgcttggatcctgttcttgggcacatggggccatttggacccatacctaggcctcagttatatattgccttcattatattaagacgtttaggcttctaggctcaaattagttttctaaacagagcaagggtactttggagctcatatgggtgcacaggaaggcctatgtcctatgatttagatctggaaccatgggatggtaaaggctgtatagtgacctagtcatttagagtatgtcaggtataatgtgttagaagctcatgcttctgcctctgcccttctaaaaccacgtgtgtcgtgccactcactgttacgtgaatcctgaaggatttcctcttctttcaaacatgaccacctggagcaagaataggtcactgactttttgtgctttctttttgattagagagacctctatctcccttggatgcataaatgaagtttcattagccatcacaccaagggcttcttagtgttgattaatgtggagctcatgttttggccaaactggtgtgagattggctatcattgggaagtgaagtatttcttaactttactggagtcaaaaatcttctgaaattagaagtgatttttttttctatctggcatacctggggctagggaagtagagaattctcagttgaaagtaaggcactttcctacttggattacaagagcagttgagttgaaaaaggtcaaagagaacagagaagtcagaagaccaagtcttgtaaactaaaacaaagacccgaagcttcagaatgtctcgattttgggcaataactcaaggaaataaatggctttttgtcattccatttcctgttttctttctctatttagatgcctatatttgttctcagttatcagtctctcattcggtagcaaaaacatccattctttgacttgtgaggtacttcctcctcttttggaatccgttgcttcttcccacctcactactgggtataagcttcttcatagtctgtaagttttaccttgggattgaagagaaattattttctgtttcaaaaattcctggttctacccctgttcagtcacaagtaggttggtagaaaacaacctgattctgaccctttctttttttttttcctgttttagtctcagtagatcttttcaagcactgtccttacagctcatgaatgtttaggtctttatcttctaagcaagcattgtacagaacacgttgtgcttcttctttttgtctgccattttgtgaacggtgtaatgtgctcagataaataatcagctgagcaggaaaagagtctactcatctattcaaattggcaaaccattgtttagtttgtatcattaaatttgctcatagcttcgaaaagctgcaatataatgtcatgagagaccacaggtaattgttcctgtcatttggttgggcttagtggagatgggggtgggcaggaacaatttgtttaaacttttaacgctattcattaagctctctgttataacattatgatctgtgatcttggccacctgtcgaactgtttaagctaaactagtgggcaattaaagttaatttaagtaaaaaattatctaacaaatccaggctacagaaaaaaaaaaaaacttagttaaatgtatttgtccttacgatactagatttacctaaacattttccttttaacaccaactgttcacgatccaggactgcctgtccatgtatcaataatgagcagtcttaagtctgctaattaattcagaaaccttggggatgtcaatgtcactgcttggcagtaccatatgcattgcccatttttccagtaacttttctttctaagttctcttaaagacttttgagaaagtaagaagctaagtgaacatatatccaatgttttgtaatgtattatattgcagcattaagtcaacaaccccttatgacgtgtacccagctaatgcatggtttcagagtggattttgcatttttcatgtgcagtaaatgatttaaaaatgtttttggtcacctttttgtgccattaaacttgtacagaaaatgcttttatggccattttcaatgggagaaagttaaaaaatggaaacagcccaccctttctgccctatagctgtagttagaattgagtacatgtagaaatacggctgtaattggtggttgtagtgttatagttgttagcttgctagtgactgcctttggagagtaaatgcatggtcttgtacatcacatttcttaaataactcattttaacctctgaaaaggatatattattccatgtggccctcttccctccctccattccctgctcccagatatcttaccattaactgtaaatacctgatttaggggccaagagtttctgccaagtaaagttagcaaggagcaaataacccaaaaggggtgaagagaatttcacaacaatttctcagaagttattgaccctttctcaaggaatggcatggttatcaaagactcagctgtcttttacataaaaatcagaggcaaattgggagtgtctttggctgccagattacagaattgaaaaattcttagaatcatacaacccaaggatgtccctgatccctgcattacttgtgaggcatttggagacatcagagatttgctgactaatatttattggggataaaaagaaaagcaaaacagagatgtgcgacagatactcaggggtttcagctaggctccagtcagcaaaggtaaggatgtgggtttagatgcattgttatctgtttcccaggcaatgcttaacacactcttagtgctttgagtgatacaaaggcagtgtttcaacaagacactctcttctttggtttgctgttctctcttggactggaatgtttggcaaggcccatgtaaactggttagagcaggccctttatatctcctgtgaccgttaatctcccccaccataatttgatgagggctgtttggtttgaggacttcaaggatgtctagagaagttcccccatgtgtgtgaggtgttgtgaactgtgaacactgtacatcttcagtgttcaatactgggcagccaaagagctgctcttgcaatctttttttggctctcaagctctgttctccatcgaattctcatttctgtgtacatttgcaagatgtgtgtaatgtcattttccaaaaataaaatttgatttcaataaaaaaaaaaaaaaaaaaa

SEQ ID NO: 197 - DNA, 8997 bp, Mus musculus
agttacaggggagaagctggacaaggcactaggacctagaaggcaactatccaccctggcaggaatttcttgcttggagctcagacaacaaaggcatagagagattggttttctttctctcagcatctccacccaaccagcagaaaaccggttgctgtggttccaccaaaatatggaacttgattttggacattttgacgaacgagacaaagcatctagaaatatgagagggtcacggatgaatggacttccaagtcccactcatagtgcccactgtagcttctacagaaccagaaccttgcaggcattaagtaatgagaagaaggccaagaaggtacgtttctaccgcaatggggaccgttacttcaaggggattgtgtacgctgtttcttctgaccgttttcgtagttttgatgcgttgctggctgacctgacccgatccttgtctgacaacattaacctgcctcagggagtgcgctacatttataccattgacggatccaggaagattggaagcatggatgaactggaagaaggggaaagctatgtctgctcctcagacaacttctttaaaaaggttgagtacaccaagaatgtcaaccccaactggtctgtcaacgtaaagacatctgccaacatgaaagccccccagtccttggctagcagcaacagtgctcaagccagagagaacaaggactttgtgcgccccaaacttgtgaccatcattcgcagcggggtgaagccacggaaggctgtgcgcgtgcttctcaacaagaaaacagcccactctttcgagcaggtcctgactgacatcacagaagcgatcaaactggaaaccggagttgtcaaaaaactctacacccttgatggaaagcaggtcacctgtctccatgatttctttggtgatgatgatgtgttcattgcttgtggtcctgaaaaattccgctatgctcaagatgatttctccttggatgagaatgaatgcagagtcatgaaagggaatccatctgccgcagctggcccaaaggcttccccaacacctcaaaagacatctgctaaaagcccaggcccaatgcgccgcagcaagtctccagctgactcaggtaacgaccaagacgcaaatggaacttccagcagtcagctctcaacacctaagtcaaagcagtctcctatctctacacccacaagccctggaagtctgcggaagcacaaggacctgtacctgccgctgtcattggatgactctgattcacttggcgattccatgtgaaagatgataggctaaatcaaagcctattattgtagcagaatactttcgctcaagtgaccaacaaggctattggtgcttaaacatttttgttattgttgcttttcaaaacactctgtagtatgtagggtttattttcttgtgacttctcttctgggccactaattcacatttaccaataagagatagattgataaccatccttttgagtgacttttccagaacttcaaagtgtgctactccatgacctttctactgaatgcttaggggcctttgtattttccccactcaatttgttcagaaactagtcttccttctctggaaggctgtttacatacacatcacttaaaatgtttatgtgtggggaaaactttcatatgcagatctaaaagcgaaaaacctaagtgtcccttgcctctgtatcttcagaatgctggaggatctcaggagagtggcaagtcagatccttggtctcactctttgctcttaattgagcccccagtgtattgtctagcattcatcctggctgttgagatggagaaacaccagcgacttttgatgtgacaccatgtgcttagggctgtggtatagggctgtctgaaagatatgaggtagaatatagggggaaaactgcccaaatttcagtaggatttgtataaagcacagtggattcctggttaacccctctactggggaaatttggaatcaatcaattgattagtttggggtacatgatgtcacatacatgatccttccaggaggctttctaatgtacaagttagtacatgaacggtatggtatccatctagctctgttctattgaatgccttgtaaacaaccaacactacaaacactgtgagaatttgttttcaggtctgacaccttttggtcgctttttatagcaagaaaccatatccttttttataaaaaactcaactctgtatttcaggagcaaaactcttcaggctccttttttataagctggtgatttttttcctttgtctaaaaaacacaagtagaaaattgaccaaaaaaatgcagaagaatactgtagtttagaaatcatgctctcactgccaaacagaaagctccgggagaaaacacaatgactagaggccaattcaatagaatcaggtttttgatacctttttaacagttacacttacagtaataatttcaatgtggaccagacattctagttatattttaaatgaaatgttatggcatattttaagtaactcttttttatctataatcctaatatttcatacttaagatgcagaaacctttcacttgactttaacattaggaaggacttctctttattacggattgatcacttgaaataactctgtctttgaggtacaggtttataacattgctttttctctgtattcatagcccataatagccaagacaacgaaagttaggtgaaagccatgcatgccaattctgtgtttgatttgacgagataggaagatttccttcacttctttgtaattgttcagatagtttgaaagatgcagcattcaaagtttggctgctgaatgacatgcagttgtccctccattctaagtagaatgagtgtggggttcatttgtgtgtgtgtgtgtgtgtgtgtgtgtgtgtgtgtgtgtgctcgcgcgcgcatgcgcaagcacgcctaggctgcttcatacttagcaaatactgcacaagacaactcaacatgaattgatgacaacttggtggcattgctgatgtgcagggggaagtaggatggcaggggtacctagagcccccttgataaatttcagatgtccttaattatgagattccaagaaacatttttgcttttggttcagcagaagggggatgatgagagctctggtttctgcttacactgctcattgaagagcccaaaatcatgaggttttgctccccccccctttattgctatgcccacatgaaatgattaagaaacccattttaatcggcccctatttttttttctacaagctcagtgatttcttagtgcctcccagaacatttgagttaattagggaaaattggttatttgggatggatagaaattgtggtaggagatctatttttaacctctgggccagatcctccagcacactctatgttgttctttgagcaaatcccatgttgtcccaagtattcatttaagatgagacatggagattctactgaaagagtgggagcaaagaaatttcaacagtccctatgcccaggcttcttggtagttctctgagcatttttctacttgtagtataatatagcactagaaaatactatggacatatcttttttagaatattcttagaacagacattcttgtataacaacagtgtcctttctgtttttctttgtgctaactacaagtaaacctttaacaaatacttttcctttatatacaggcacagatacatacatataagaaaacttttttttactgctacttcgtgtggcaagggttggtaaaattgaaaactcaagtctccaataatttagttttaaattggctcaaattcaagtaatttttttcagaactaagctcttacatcccccgtattctttctcagtttttcctaatccacttttaccactttagtcccatcaagttcagcgtgcatggtcagcaagcatttgccactattttccataacaccccctctctctttttccctcctcctccctccttctctctctctctctctctctctctctctctctctctcacacacacacacacacacacacacaaagaatatgttgcttgttcctacctcctgactgttcttccccacagaaatagaaataggggcaaaaaaaaaaaagggaaatgtatatataggggctgggttgaacaactaacttcgtaagtagtgctaagtataattaaagtgagagaaaagctccttttctcataattgttttggaaaggatagccattagcatgactgctttgtgtccttgtggactttagtattagcctagactgaattatagcattttctagctggaaagaggattaagatctcatcatctgctcccaatttttcattttcttaaggccaggaaacagacaaagacataaagtgatttccccctaaggtcacacagctgcccattggcagtgctgggattagaacctacacctcttggctcttattccaatttttttcccccaactagtgagtattgtcctttgtgaggctcctgcaaattctttcccagggtcatgttgcaccctggatccatatgctactttgttggtctcagcaagaaatccacacagcaatataatctggcccttcctcctcactttcacattacttcatccacatggcctgcagacagttccaaggagagggaggcattgagacgttgagcaccagagggttgctgccctaccttgaggaatcttccaaatagctcgctgaactccactctattcatggagaatggaaaatgactactttgtcccttatcagcttccttcaaggtcatgtcacacgtgttcctcccaggataggggagtgatttccagagcacagaaaattagaagtgaataacagagtaatagctttgtttattctgactttctaaagatgacttttttttagccatttaaaaaattagtctggctatctttactactaataacaatttcctttaaaatatggcagtgagccaagccagagaaagataatcaagtcttgtgtttatcctcaatctctacgcccttgtagccatgctccctggtacaaacaattttcaggtataaacaagtgtcttttgtcactaaattgtgccctggctgacactgaatatttgtatctataccaaaaatagcatacagtgaccttacacattatattctctctctctctctctctctctctctctctctctctctctctctctgtgtagcctgtttctgtgctttccatgacagaagttagggcaacatgatctgtatgtgtaggtttctttgcagcaaggctttcctggaactaatgaatattcactgaattctagaagatctcttactaaatttacccaagttcaggaacttctctatcttttcttccctccatctgggagtgaccaaggaattgtaaagtgggtaggtagcttccatgtcctagaatcatcaagcctaagttgaaggcaaatgactcaatgcttgatttgcataaacttgtgtccccatgcccagtctctccaatagtctacatagagatttccccatttcctctcacatttgactccaaatggatttttcctttagaaaacagggaaggaaataagccctatctccttagaatgggagcgatcacacacccatgggtccccaatgagcttctgtgatggtgagaatgttgcaagagatgagactgccttgggaacagttgtatcaagagacttctctagcagaaacccaatgacagcatagctttacggacttccttcatggtctagtttgctatggaaatagaaaacataggatctttctcttttctttctttttttttcttctttttgaaacaatgcttggatcctgttcttgggcacatggggccatttggacccatacctaggcctcagttatatattgccttcattatattaagacgtttaggcttctaggctcaaattagttttctaaacagagcaagggtactttggagctcatatgggtgcacaggaaggcctatgtcctatgatttagatctggaaccatgggatggtaaaggctgtatagtgacctagtcatttagagtatgtcaggtataatgtgttagaagctcatgcttctgcctctgcccttctaaaaccacgtgtgtcgtgccactcactgttacgtgaatcctgaaggatttcctcttctttcaaacatgaccacctggagcaagaataggtcactgactttttgtgctttctttttgattagagagacctctatctcccttggatgcataaatgaagtttcattagccatcacaccaagggcttcttagtgttgattaatgtggagctcatgttttggccaaactggtgtgagattggctatcattgggaagtgaagtatttcttaactttactggagtcaaaaatcttctgaaattagaagtgatttttttttctatctggcatacctggggctagggaagtagagaattctcagttgaaagtaaggcactttcctacttggattacaagagcagttgagttgaaaaaggtcaaagagaacagagaagtcagaagaccaagtcttgtaaactaaaacaaagacccgaagcttcagaatgtctcgattttgggcaataactcaaggaaataaatggctttttgtcattccatttcctgttttctttctctatttagatgcctatatttgttctcagttatcagtctctcattcggtagcaaaaacatccattctttgacttgtgaggtacttcctcctcttttggaatccgttgcttcttcccacctcactactgggtataagcttcttcatagtctgtaagttttaccttgggattgaagagaaattattttctgtttcaaaaattcctggttctacccctgttcagtcacaagtaggttggtagaaaacaacctgattctgaccctttctttttttttttcctgttttagtctcagtagatcttttcaagcactgtccttacagctcatgaatgtttaggtctttatcttctaagcaagcattgtacagaacacgttgtgcttcttctttttgtctgccattttgtgaacggtgtaatgtgctcagataaataatcagctgagcaggaaaagagtctactcatctattcaaattggcaaaccattgtttagtttgtatcattaaatttgctcatagcttcgaaaagctgcaatataatgtcatgagagaccacaggtaattgttcctgtcatttggttgggcttagtggagatgggggtgggcaggaacaatttgtttaaacttttaacgctattcattaagctctctgttataacattatgatctgtgatcttggccacctgtcgaactgtttaagctaaactagtgggcaattaaagttaatttaagtaaaaaattatctaacaaatccaggctacagaaaaaaaaaaaaacttagttaaatgtatttgtccttacgatactagatttacctaaacattttccttttaacaccaactgttcacgatccaggactgcctgtccatgtatcaataatgagcagtcttaagtctgctaattaattcagaaaccttggggatgtcaatgtcactgcttggcagtaccatatgcattgcccatttttccagtaacttttctttctaagttctcttaaagacttttgagaaagtaagaagctaagtgaacatatatccaatgttttgtaatgtattatattgcagcattaagtcaacaaccccttatgacgtgtacccagctaatgcatggtttcagagtggattttgcatttttcatgtgcagtaaatgatttaaaaatgtttttggtcacctttttgtgccattaaacttgtacagaaaatgcttttatggccattttcaatgggagaaagttaaaaaatggaaacagcccaccctttctgccctatagctgtagttagaattgagtacatgtagaaatacggctgtaattggtggttgtagtgttatagttgttagcttgctagtgactgcctttggagagtaaatgcatggtcttgtacatcacatttcttaaataactcattttaacctctgaaaaggatatattattccatgtggccctcttccctccctccattccctgctcccagatatcttaccattaactgtaaatacctgatttaggggccaagagtttctgccaagtaaagttagcaaggagcaaataacccaaaaggggtgaagagaatttcacaacaatttctcagaagttattgaccctttctcaaggaatggcatggttatcaaagactcagctgtcttttacataaaaatcagaggcaaattgggagtgtctttggctgccagattacagaattgaaaaattcttagaatcatacaacccaaggatgtccctgatccctgcattacttgtgaggcatttggagacatcagagatttgctgactaatatttattggggataaaaagaaaagcaaaacagagatgtgcgacagatactcaggggtttcagctaggctccagtcagcaaaggtaaggatgtgggtttagatgcattgttatctgtttcccaggcaatgcttaacacactcttagtgctttgagtgatacaaaggcagtgtttcaacaagacactctcttctttggtttgctgttctctcttggactggaatgtttggcaaggcccatgtaaactggttagagcaggccctttatatctcctgtgaccgttaatctcccccaccataatttgatgagggctgtttggtttgaggacttcaaggatgtctagagaagttcccccatgtgtgtgaggtgttgtgaactgtgaacactgtacatcttcagtgttcaatactgggcagccaaagagctgctcttgcaatctttttttggctctcaagctctgttctccatcgaattctcatttctgtgtacatttgcaagatgtgtgtaatgtcattttccaaaaataaaatttgatttcaataaaaaaaaaaaaaaaaaaa

SEQ ID NO: 198 - DNA, 8982 bp, Mus musculus
agttacaggggagaagctggacaaggcactaggacctagaaggcaactatccaccctggcaggaatttcttgcttggagctcagacaacaaaggcatagagagattggttttctttctctcagcatctccacccaaccagcagaaaaccggttgctgtggttccaccaaaatatggaacttgattttggacattttgacgaacgagacaaagcatctagaaatatgagagggtcacggatgaatggacttccaagtcccactcatagtgcccactgtagcttctacagaaccagaaccttgcaggcattaagtaatgagaagaaggccaagaaggtacgtttctaccgcaatggggaccgttacttcaaggggattgtgtacgctgtttcttctgaccgttttcgtagttttgatgcgttgctggctgacctgacccgatccttgtctgacaacattaacctgcctcagggagtgcgctacatttataccattgacggatccaggaagattggaagcatggatgaactggaagaaggggaaagctatgtctgctcctcagacaacttctttaaaaaggttgagtacaccaagaatgtcaaccccaactggtctgtcaacgtaaagacatctgccaacatgaaagccccccagtccttggctagcagcaacagtgctcaagccagagagaacaaggactttgtgcgccccaaacttgtgaccatcattcgcagcggggtgaagccacggaaggctgtgcgcgtgcttctcaacaagaaaacagcccactctttcgagcaggtcctgactgacatcacagaagcgatcaaactggaaaccggagttgtcaaaaaactctacacccttgatggaaagcaggtcacctgtctccatgatttctttggtgatgatgatgtgttcattgcttgtggtcctgaaaaattccgctatgctcaagatgatttctccttggatgagaatgaatgcagagtcatgaaagggaatccatctgccgcagctggcccaaaggcttccccaacacctcaaaagacatctgctaaaagcccaggcccaatgcgccgcagcaagtctccagctgactcagcaaatggaacttccagcagtcagctctcaacacctaagtcaaagcagtctcctatctctacacccacaagccctggaagtctgcggaagcacaaggacctgtacctgccgctgtcattggatgactctgattcacttggcgattccatgtgaaagatgataggctaaatcaaagcctattattgtagcagaatactttcgctcaagtgaccaacaaggctattggtgcttaaacatttttgttattgttgcttttcaaaacactctgtagtatgtagggtttattttcttgtgacttctcttctgggccactaattcacatttaccaataagagatagattgataaccatccttttgagtgacttttccagaacttcaaagtgtgctactccatgacctttctactgaatgcttaggggcctttgtattttccccactcaatttgttcagaaactagtcttccttctctggaaggctgtttacatacacatcacttaaaatgtttatgtgtggggaaaactttcatatgcagatctaaaagcgaaaaacctaagtgtcccttgcctctgtatcttcagaatgctggaggatctcaggagagtggcaagtcagatccttggtctcactctttgctcttaattgagcccccagtgtattgtctagcattcatcctggctgttgagatggagaaacaccagcgacttttgatgtgacaccatgtgcttagggctgtggtatagggctgtctgaaagatatgaggtagaatatagggggaaaactgcccaaatttcagtaggatttgtataaagcacagtggattcctggttaacccctctactggggaaatttggaatcaatcaattgattagtttggggtacatgatgtcacatacatgatccttccaggaggctttctaatgtacaagttagtacatgaacggtatggtatccatctagctctgttctattgaatgccttgtaaacaaccaacactacaaacactgtgagaatttgttttcaggtctgacaccttttggtcgctttttatagcaagaaaccatatccttttttataaaaaactcaactctgtatttcaggagcaaaactcttcaggctccttttttataagctggtgatttttttcctttgtctaaaaaacacaagtagaaaattgaccaaaaaaatgcagaagaatactgtagtttagaaatcatgctctcactgccaaacagaaagctccgggagaaaacacaatgactagaggccaattcaatagaatcaggtttttgatacctttttaacagttacacttacagtaataatttcaatgtggaccagacattctagttatattttaaatgaaatgttatggcatattttaagtaactcttttttatctataatcctaatatttcatacttaagatgcagaaacctttcacttgactttaacattaggaaggacttctctttattacggattgatcacttgaaataactctgtctttgaggtacaggtttataacattgctttttctctgtattcatagcccataatagccaagacaacgaaagttaggtgaaagccatgcatgccaattctgtgtttgatttgacgagataggaagatttccttcacttctttgtaattgttcagatagtttgaaagatgcagcattcaaagtttggctgctgaatgacatgcagttgtccctccattctaagtagaatgagtgtggggttcatttgtgtgtgtgtgtgtgtgtgtgtgtgtgtgtgtgtgtgtgctcgcgcgcgcatgcgcaagcacgcctaggctgcttcatacttagcaaatactgcacaagacaactcaacatgaattgatgacaacttggtggcattgctgatgtgcagggggaagtaggatggcaggggtacctagagcccccttgataaatttcagatgtccttaattatgagattccaagaaacatttttgcttttggttcagcagaagggggatgatgagagctctggtttctgcttacactgctcattgaagagcccaaaatcatgaggttttgctccccccccctttattgctatgcccacatgaaatgattaagaaacccattttaatcggcccctatttttttttctacaagctcagtgatttcttagtgcctcccagaacatttgagttaattagggaaaattggttatttgggatggatagaaattgtggtaggagatctatttttaacctctgggccagatcctccagcacactctatgttgttctttgagcaaatcccatgttgtcccaagtattcatttaagatgagacatggagattctactgaaagagtgggagcaaagaaatttcaacagtccctatgcccaggcttcttggtagttctctgagcatttttctacttgtagtataatatagcactagaaaatactatggacatatcttttttagaatattcttagaacagacattcttgtataacaacagtgtcctttctgtttttctttgtgctaactacaagtaaacctttaacaaatacttttcctttatatacaggcacagatacatacatataagaaaacttttttttactgctacttcgtgtggcaagggttggtaaaattgaaaactcaagtctccaataatttagttttaaattggctcaaattcaagtaatttttttcagaactaagctcttacatcccccgtattctttctcagtttttcctaatccacttttaccactttagtcccatcaagttcagcgtgcatggtcagcaagcatttgccactattttccataacaccccctctctctttttccctcctcctccctccttctctctctctctctctctctctctctctctctctctcacacacacacacacacacacacacaaagaatatgttgcttgttcctacctcctgactgttcttccccacagaaatagaaataggggcaaaaaaaaaaaagggaaatgtatatataggggctgggttgaacaactaacttcgtaagtagtgctaagtataattaaagtgagagaaaagctccttttctcataattgttttggaaaggatagccattagcatgactgctttgtgtccttgtggactttagtattagcctagactgaattatagcattttctagctggaaagaggattaagatctcatcatctgctcccaatttttcattttcttaaggccaggaaacagacaaagacataaagtgatttccccctaaggtcacacagctgcccattggcagtgctgggattagaacctacacctcttggctcttattccaatttttttcccccaactagtgagtattgtcctttgtgaggctcctgcaaattctttcccagggtcatgttgcaccctggatccatatgctactttgttggtctcagcaagaaatccacacagcaatataatctggcccttcctcctcactttcacattacttcatccacatggcctgcagacagttccaaggagagggaggcattgagacgttgagcaccagagggttgctgccctaccttgaggaatcttccaaatagctcgctgaactccactctattcatggagaatggaaaatgactactttgtcccttatcagcttccttcaaggtcatgtcacacgtgttcctcccaggataggggagtgatttccagagcacagaaaattagaagtgaataacagagtaatagctttgtttattctgactttctaaagatgacttttttttagccatttaaaaaattagtctggctatctttactactaataacaatttcctttaaaatatggcagtgagccaagccagagaaagataatcaagtcttgtgtttatcctcaatctctacgcccttgtagccatgctccctggtacaaacaattttcaggtataaacaagtgtcttttgtcactaaattgtgccctggctgacactgaatatttgtatctataccaaaaatagcatacagtgaccttacacattatattctctctctctctctctctctctctctctctctctctctctctctctgtgtagcctgtttctgtgctttccatgacagaagttagggcaacatgatctgtatgtgtaggtttctttgcagcaaggctttcctggaactaatgaatattcactgaattctagaagatctcttactaaatttacccaagttcaggaacttctctatcttttcttccctccatctgggagtgaccaaggaattgtaaagtgggtaggtagcttccatgtcctagaatcatcaagcctaagttgaaggcaaatgactcaatgcttgatttgcataaacttgtgtccccatgcccagtctctccaatagtctacatagagatttccccatttcctctcacatttgactccaaatggatttttcctttagaaaacagggaaggaaataagccctatctccttagaatgggagcgatcacacacccatgggtccccaatgagcttctgtgatggtgagaatgttgcaagagatgagactgccttgggaacagttgtatcaagagacttctctagcagaaacccaatgacagcatagctttacggacttccttcatggtctagtttgctatggaaatagaaaacataggatctttctcttttctttctttttttttcttctttttgaaacaatgcttggatcctgttcttgggcacatggggccatttggacccatacctaggcctcagttatatattgccttcattatattaagacgtttaggcttctaggctcaaattagttttctaaacagagcaagggtactttggagctcatatgggtgcacaggaaggcctatgtcctatgatttagatctggaaccatgggatggtaaaggctgtatagtgacctagtcatttagagtatgtcaggtataatgtgttagaagctcatgcttctgcctctgcccttctaaaaccacgtgtgtcgtgccactcactgttacgtgaatcctgaaggatttcctcttctttcaaacatgaccacctggagcaagaataggtcactgactttttgtgctttctttttgattagagagacctctatctcccttggatgcataaatgaagtttcattagccatcacaccaagggcttcttagtgttgattaatgtggagctcatgttttggccaaactggtgtgagattggctatcattgggaagtgaagtatttcttaactttactggagtcaaaaatcttctgaaattagaagtgatttttttttctatctggcatacctggggctagggaagtagagaattctcagttgaaagtaaggcactttcctacttggattacaagagcagttgagttgaaaaaggtcaaagagaacagagaagtcagaagaccaagtcttgtaaactaaaacaaagacccgaagcttcagaatgtctcgattttgggcaataactcaaggaaataaatggctttttgtcattccatttcctgttttctttctctatttagatgcctatatttgttctcagttatcagtctctcattcggtagcaaaaacatccattctttgacttgtgaggtacttcctcctcttttggaatccgttgcttcttcccacctcactactgggtataagcttcttcatagtctgtaagttttaccttgggattgaagagaaattattttctgtttcaaaaattcctggttctacccctgttcagtcacaagtaggttggtagaaaacaacctgattctgaccctttctttttttttttcctgttttagtctcagtagatcttttcaagcactgtccttacagctcatgaatgtttaggtctttatcttctaagcaagcattgtacagaacacgttgtgcttcttctttttgtctgccattttgtgaacggtgtaatgtgctcagataaataatcagctgagcaggaaaagagtctactcatctattcaaattggcaaaccattgtttagtttgtatcattaaatttgctcatagcttcgaaaagctgcaatataatgtcatgagagaccacaggtaattgttcctgtcatttggttgggcttagtggagatgggggtgggcaggaacaatttgtttaaacttttaacgctattcattaagctctctgttataacattatgatctgtgatcttggccacctgtcgaactgtttaagctaaactagtgggcaattaaagttaatttaagtaaaaaattatctaacaaatccaggctacagaaaaaaaaaaaaacttagttaaatgtatttgtccttacgatactagatttacctaaacattttccttttaacaccaactgttcacgatccaggactgcctgtccatgtatcaataatgagcagtcttaagtctgctaattaattcagaaaccttggggatgtcaatgtcactgcttggcagtaccatatgcattgcccatttttccagtaacttttctttctaagttctcttaaagacttttgagaaagtaagaagctaagtgaacatatatccaatgttttgtaatgtattatattgcagcattaagtcaacaaccccttatgacgtgtacccagctaatgcatggtttcagagtggattttgcatttttcatgtgcagtaaatgatttaaaaatgtttttggtcacctttttgtgccattaaacttgtacagaaaatgcttttatggccattttcaatgggagaaagttaaaaaatggaaacagcccaccctttctgccctatagctgtagttagaattgagtacatgtagaaatacggctgtaattggtggttgtagtgttatagttgttagcttgctagtgactgcctttggagagtaaatgcatggtcttgtacatcacatttcttaaataactcattttaacctctgaaaaggatatattattccatgtggccctcttccctccctccattccctgctcccagatatcttaccattaactgtaaatacctgatttaggggccaagagtttctgccaagtaaagttagcaaggagcaaataacccaaaaggggtgaagagaatttcacaacaatttctcagaagttattgaccctttctcaaggaatggcatggttatcaaagactcagctgtcttttacataaaaatcagaggcaaattgggagtgtctttggctgccagattacagaattgaaaaattcttagaatcatacaacccaaggatgtccctgatccctgcattacttgtgaggcatttggagacatcagagatttgctgactaatatttattggggataaaaagaaaagcaaaacagagatgtgcgacagatactcaggggtttcagctaggctccagtcagcaaaggtaaggatgtgggtttagatgcattgttatctgtttcccaggcaatgcttaacacactcttagtgctttgagtgatacaaaggcagtgtttcaacaagacactctcttctttggtttgctgttctctcttggactggaatgtttggcaaggcccatgtaaactggttagagcaggccctttatatctcctgtgaccgttaatctcccccaccataatttgatgagggctgtttggtttgaggacttcaaggatgtctagagaagttcccccatgtgtgtgaggtgttgtgaactgtgaacactgtacatcttcagtgttcaatactgggcagccaaagagctgctcttgcaatctttttttggctctcaagctctgttctccatcgaattctcatttctgtgtacatttgcaagatgtgtgtaatgtcattttccaaaaataaaatttgatttcaataaaaaaaaaaaaaaaaaaa

SEQ ID NO: 199 - DNA, 8814 bp, Rattus norvegicus
atggaacttgattttggacattttgacgaacgagacaaagcatctagaaatatgagagggtcacggatgaatggacttccaagtcccactcatagtgctcactgtagcttctacagaaccagaaccttgcaggcattaagtaatgagaagaaggccaagaaggtacgtttctaccgcaatggggaccgttacttcaaggggattgtgtacgctgtttcttctgaccgttttcgtagttttgatgcattgctggctgacctgactcgatccttgtccgacaacatcaacctgcttcagggagtgcgttacatttacactattgatggatccagaaagattggaagcatggatgaactggaagaaggggaaagctatgtctgttcctcagacaacttctttaaaaaggttgagtataccaagaatgtcaatcccaactggtcggtcaatgtaaagacatcagccaacatgaaagcgccccagtccttggctagcagcaacagtgctcaagccagagagaacaaggacttcgtgcgccccaaacttgtgaccatcattcgcagtggggtgaagcctcggaaggcggtgcgtgtgcttctcaacaagaaaacagcccactctttcgagcaggtcctcactgacatcacagaagcgatcaaactggaaaccggagttgtcaaaaaactctatacccttgatggaaagcaggtcacctgtctccatgatttctttggtgatgatgatgtgttcattgcttgtggccctgaaaagttccgctatgctcaagatgacttctccttggatgagaatgaatgcagagtcatgaaagggaatccatctgccacagctggcccaaaagcttccccaacacctcaaaagacatctgctaaaagcccaggcccaatgcgccgcagcaagtctccagctgactcaggtaacgaccaagacgcaaatggaacttctagcagtcagctctcaacacctaagtcgaagcagtctcctatctctacacccacaagccctggaagtctgcggaagcacaaggacttgtacctgccactgtcattggatgactctgattcacttggcgattccatgtgaaagatgataggctaaatcaaagcctattattgtagcagaatactttcgctcaagtgaccaacaaggctattggtgcttaaacatttttgttattgttgcttttcaaaacactctgtagtatgtagggtttattttcttgtgacttctcttctgggccactaattcacatttaccaataagagatagattgataaccatccttttgagtgacttttccagaacttcaaagtgtgctactccatgacctttctactgaatgcttaggggcctttgtattttccccactcaatttgttcagaaactagtcttccttctctggaaggctgtttacatacacatcacttaaaatgtttatgtgtggggaaaactttcatatgcagatctaaaagcgaaaaacctaagtgtcccttgcctctgtatcttcagaatgctggaggatctcaggagagtggcaagtcagatccttggtctcactctttgctcttaattgagcccccagtgtattgtctagcattcatcctggctgttgagatggagaaacaccagcgacttttgatgtgacaccatgtgcttagggctgtggtatagggctgtctgaaagatatgaggtagaatatagggggaaaactgcccaaatttcagtaggatttgtataaagcacagtggattcctggttaacccctctactggggaaatttggaatcaatcaattgattagtttggggtacatgatgtcacatacatgatccttccaggaggctttctaatgtacaagttagtacatgaacggtatggtatccatctagctctgttctattgaatgccttgtaaacaaccaacactacaaacactgtgagaatttgttttcaggtctgacaccttttggtcgctttttatagcaagaaaccatatccttttttataaaaaactcaactctgtatttcaggagcaaaactcttcaggctcctttttttataagctggtgatttttttcctttgtctaaaaaacacaagtagaaaattgaccaaaaaaatgcagaagaatactgtagtttagaaatcatgctctcactgccaaacagaaagctccgggagaaaacacaatgactagaggccaattcaatagaatcaggtttttgatacctttttaacagttacacttacagtaataatttcacatgtggaccagacattctagttatattttaaatgaaatgttatggcatattttaagtaactcttttttatctataatcctaatatttcatacttaagatgcagaaacctttcacttgactttaacattaggaaggacttctctttattacggattgatcacttgaaataactctgtctttgaggtacaggtttataacattgctttttctctgtattcatagcccataatagccaagacaacgaaagttaggtgaaagccatgcatgccaattctgtgtttgatttgacgagataggaagatttccttcacttctttgtaattgttcagatagtttgaaagatgcagcattcaaagtttggctgctgaatgacatgcagttgtccctccattctaagtagaatgagtgtggggttcatttgtgtgtgtgtgtgtgtgtgtgtgtgtgtgtgtgtgtgtgtgctcgcgcgcgcatgcgcaagcacgcctaggctgcttcatacttagcaaatactgcacaagacaactcaacatgaattgatgacaacttggtggcattgctgatgtgcagggggaagtaggatggcaggggtacctagagcccccttgataaatttcagatgtccttaattatgagattccaagaaacatttttgcttttggttcagcagaagggggatgatgagagctctggtttctgcttacactgctcattgaagagcccaaaatcatgaggttttgctccccccccctttattgctatgcccacatgaaatgattaagaaacccattttaatcggcccctatttttttcttctacttatttttttttctacaagctcagtgatttcttagtgcctcccagaacatttgagttaattagggaaaattggttatttgggatggatagaaattgtggtaggagatctatttttaacctctgggccagatcctccagcacactctatgttgttctttgagcaaatcccatgttgtcccaagtattcatttaagatgagacatggagattctactgaaagagtgggagcaaagaaatttcaacagtccctatgcccaggcttcttggtagttctctgagcatttttctacttgtagtataatatagcactagaaaatactatggacatatcttttttagaatattcttagaacagacattcttgtataacaacagtgtcctttctgtttttctttgtgctaactacaagtaaacctttaacaaatacttttcctttatatacaggcacagatacatacatataagaaaacttttttttactgctacttcgtgtggcaagggttggtaaaattgaaaactcaagtctccaataatttagttttaaattggctcaaattcaagcaatttttttcagaactaagctcttacatcccccgtattctttctcagtttttcctaatccacttttaccactttagtcccatcaagttcagcgtgcatggtcagcaagcatttgccactattttccataacaccccctctctctttttccctcctcctccctccttctctctctctctctctctctctctctctctctctctctcacgcacacacacacacacacacaaagaatatgttgcttgttcctacctcctgactgttcttccccacagaaatagaaataggggcaaaaaaaaaagggaaatgtatatataggggctgggttgaacaactaacttcgtaagtagtgctaagtataattaaagtgagagaaaagctccttttctcataattgttttggaaaggatagccattagcatgactgctttgtgtccttgtggactttagtattagcctagactgaattatagcattttctagctggaaagaggattaagatctcatcatctgctcccatttttcattttcttaaggccaggaaacagacaaagacataaagtgatttccccctaaggtcacacagctgcccattggcagtgctgggattagaacctacacctcttggctcttattccaatttttttcccccaactagtgagtattgtcctttgtgaggctcctgcaaattctttcccagggtcatgttgcaccctggatccatatgctactttgttggtctcagcaagaaatccacacagcaatataatctggcccttcctcctcactttcacattacttcatccacatggcctgcagacagttccaaggagagggaggcattgagacgttgagcaccagagggttgctgccctaccttgaggaatcttccaaatagctcgctgaactccactctattcatggagaatggaaaatgactactttgtcccttatcagcttccttcaaggtcatgtcacacgtgttcctcccaggataggggagtgatttccagagcacagaaaattagaagtgaataacagagtaatagctttgtttattctgactttctaaagatgactttttttagccatttaaaaaattagtctggctatctttactactaataacaatttcctttaaaatatggcagtgagccaagccagagaaagataatcaagtcttgtgtttatcctcaatctctacgcccttgtagccatgctccctggtacaaataattttcaggtataaacaagtgtcttttgtcactaaattgtgccctggctgacactgaatatttgtatctataccaaaaatagcatacagtgaccttacacattatattctctctctctctctctctctctctctctctctctctctctctctctgtgtagcctgtttctgtgctttccatgacagaagttagggcaacatgatctgtatgtgtaggtttctttgcagcaaggctttcctggaactaatgaatattcactgaattctagaagatctcttactaaatttacccaagttcaggaacttctctatcttttcttccctccatctgggagtgaccaaggaattgtaaagtgggtaggtagcttccatgtcctagaatcatcaagcctaagttgaaggcaaatgactcaatgcttgatttgcataaacttgtgtccccatgcccagtctctccaatagtctacatagagatttccccatttcctctcacatttgactccaaatggatttttcctttagaaaacagggaaggaaataagccctatctccttagaatgggagcgatcacacacccatgggtccccaatgagcttctgtgatggtgagaatgttgcaagagatgagactgccttgggaacagttgtatcaagagacttctctagcagaaacccaatgacagcatagctttacggacttccttcatggtctagtttgctatggaaatagaaaacataggatctttctcttttctttctttttttttcttctttttgaaacaatgcttggatcctgttcttgggcacatggggccatttggacccatacctaggcctcagttatatattgccttcattatattaagacgtttaggcttctaggctcaaattagttttctaaacagagcaagggtactttggagctcatatgggtgcacaggaaggcctatgtcctatgatttagatctggaaccatgggatggtaaaggctgtatagtgacctagtcatttagagtatgtcaggtataatgtgttagaagctcatgcttctgcctctgcccttctaaaaccacgtgtgtcgtgccactcactgttacgtgaatcctgaaggatttcctcttctttcaaacatgaccacctggagcaagaataggtcactgactttttgtgctttctttttgattagagagacctctatctcccttggatgcataaatgaagtttcattagccatcacaccaagggcttcttagtgttgattaatgtggagctcatgttttggccaaactggtgtgagattggctatcattgggaagtgaagtatttcttaactttactggagtcaaaaatcttctgaaattagaagtgatttttttttctatctggcatacctggggctagggaagtagagaattctcagttgaaagtaaggcactttcctacttggattacaagagcagttgagttgaaaaaggtcaaagagaacagagaagtcagaagaccaagtcttgtaaactaaaacaaagacccgaagcttcagaatgtctcgattttgggcaataactcaaggaaataaatggctttttgtcattccatttcctgttttctttctctatttagatgcctatatttgttctcagttatcagtctctcattcggtagcaaaaacatccattctttgacttgtgaggtacttcctcctcttttggaatccgttgcttcttcccacctcactactgggtataagcttcttcatagtctgtaagttttaccttgggattgaagagaaattattttctgtttcaaaaattcctggttctacccctgttcagtcacaagtaggttggtagaaaacaacctgattctgaccctttctttctttttttcctgttttagtctcagtagatcttttcaagcactgtccttacagctcatgaatgtttaggtctttatcttctaagcaagcattgtacagaacacgttgtgcttcttctttttgtctgccattttgtgaacggtgtaatgtgctcagataaataatcagctgagcaggaaaagagtctactcatctattcaaattggcaaaccattgtttagtttgtatcattaaatttgctcatagcttcgaaaagctgcaatataatgtcatgagagaccacaggtaattgttcctgtcatttggttgggcttagtggagatgggggtgggcaggcacgagatttgtttaaacttttaccactattcattaagctctctctgttataacattatgatctgtgtttgccacttattgaattatttaagctaagctggtaggcaattaaaattaatttaagtcaaaaagtatctaacacatctaggctaaagaaaaaaaatacttagttgaaatgtatttgtccttccaatattagatttacctaaacattttccttttaacatcaactgttcatgatccaggactgtctgtccatgtatgtcctgtaaattagcaggcttaagtctactgattaattcaacagagttcagaatccctgggatgtcaatgtcactgcttggcaataccatatgtattgcctattttttccagtgactttctttctaagttctcttaaagaggtttgcgaaagtaagaagttaagctaaaatatatccaatgttgggtagtgtatcatattgcagcattaaaccaacaaccctttatgacttatacacagctaatgcatggtttgagagtggattttgcatttttcatgtgcagtaaattatttaaaatgttttgggtcacctttttgtgccattaacttgtccagaaaagcttatggccattttcaaagggagaaagtttaaaatggaaacagcccaccctttctgccctatagctgtagttagaattgagtacgtgtagaaaaacggctgtaattggtggttgtagtgttagagtttgttagctggctagtgactacctttggagagtaaatgcatggtcttgtacatcacatttcttaataactctttttaacctcggaaaagaatatattattccatgtggccctcttccctccctccactccctgctcccagatatcttaccattaactgtaaataaccgatttaggggccaagaattcctgccaagtaaagtcagaaacgagcaaaaaaaccaaggggcgtgtgtgaagagaattttacaacaatttctcagaagtcatgaccatttctaaaggaaaggcacggttatcaaagcttcagctgtctttgacctaaaaatcagaggcaaattgggagggtctttggctgccagattacagtatagaattgaataattcttagaatcatacaacccaaggatgtccctgatccctgcactagttgtgaggtatttggatgcatcaaggtgtgttgacctatatttattggggacaaaagaaaagcaaatgtgcaacgaatgctcaggggtttcagctaggccccagtcagcaaaagcaaggaggtgagtttagatagatgcattgtctgtttcccaggcaatgcttagactttgagtgatacaaaggcagtgtttcaagaagacactctcttctttggtttgctgttctctcttggacggatgtttggcaaggcccatgtaagctggttagagcaggtcttttatctcccccaccataatttgatgagggctctttggtttgaggacttcaaggctgtctagagaagttcccccatgtgtgtgaggtgttgtgaactgtgacaccgtaacatcttcagtgttcaatacagggcagccaaagagctgctcttgcaatcttttttggctctcaagctctgttctccatcgaattctcatttctgtgtacatttgcaagatgtgtgtaatgtcattttccaaaaataaaatttgatttcaataaaaaaaaaaaaaaaaaaa

SEQ ID NO: 200 - DNA, 4525 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 201 - DNA, 4513 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 202 - DNA, 5134 bp, Pan troglodytes
  modified_base (4536)..(4623): a, c, t, g, unknown or other
aagagcccgggcttacccagatgttagtcactaacgtccttccgttctctcgtctctcttcccccacccttcccttcccttctcccctctcccagtgcccccactcccaactcccgccccaagccgcccaccagcccccttcccctccggccggagcctgaaccgagcccggctggctgtgctgcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgctccactctggctccttcaccatcacgggcaacaacagcaactttgcccagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctgttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcgtggctaacctgaaggttaaagatgcaactcagatcactcaggggccccgcagcgcaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctatggatgtgaagggggaaggaaatgagaccaccaatatggtcatcacgtggaagccgctccggtggatggactggaacgccccccaggttcagtaccgcgtgcaatggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtaacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctctcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacctcccccatcaaccctgccgtggccctagaatagtggagtccaggacaggagatgctgtgcccctggccttgggatgcaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggtttgcaccttcccccttccccagccactccccagccagcctggctgggactgggaacagaagtcggtgtccccaccatctgctgtcttttctttgccatctctgctccaaccgggatgggagccgggcaaactggccgcgggggcaggggaggccatctggaaagcccaaattccccccactcccannnnnnnnnnnnnnnnnnnnnnnnnnnnnnnnnnnnnnnnnnnnnnnnnnnnnnnnnnnnnnnnnnnnnnnnnnnnnnnnnnnnnnnngtacccaccagacaacatccaagtggctccgtcactactggctgcggggcgggcacacctcctcccactgcccactggccgcctcttccagccgcccccaccccccaggaccccttagcagccctgccctccctatcgtctgaacggttgtcttcctcagcctcctcccgcccccaccttgggaatgtaaatacaccgtgactttgaaagtttgtacccctgtccttccctttacgccactagtgtgtaggcagatgtctgagtccctaggtggtttctaggattgatagcaattagctttgatgaacccatcccaggaaaaataaaaacagacaaaaaaaaaggaaagattggttctcccagcactgctgcgcccctgctcagcagccacagcctccctgtatgcctgtgcttggtctactgataagccctctacaaaaaaacaaaagtatatatatatatgtacataatatcagaattataacaggcaaataaaacctgaaaatcaaga

SEQ ID NO: 203 - DNA, 3771 bp, Canis lupus
atggccgtgtcgctgcggtacttgtggcctctccttctctgcagcccctgcctgctcatccagatccccgacgaatatgaaggataccgcgtgatggagccacctgtcatcacggaacagtccccacggcgcctggtcgtcttccccacagatgacatcagcctcaagtgtgaggccagtggcaaaccggaagtgcagttccgctggactcgggatggcgtccacttcaaacccaaggaagagctgggtgtgaccgtgcaccaggcgccacattctggctccttcaccatcacgggcaacaacagcaactttgcccagaggttccagggcacctaccgctgctttgccagcaataagctgggcacggccatgtcccatgagatccagctcatggccgagggtgcccccaagtggccgaaagagatggtgaaacccgtggaggtggaggaaggggagtcggtcattttgccttgccacccgccacccagcgccgagccgctgcgcatctactggatgaatagcaagatcttgcacatcaaacaggatgagcgggtgacaatgggccagaacggcaatctctacttcgccaacgtgctcacctcggacaaccactcagactacatctgccatgcccactttcctggcacccggaccatcatccagaaggaacccattgacctccgggtcaaggccaccaacagcatgatcgacaggaagcctcgcctgctcttccccaccaactccagcagccacctggtagccctgcaggggcagccactggtcctggagtgcatcgccgagggcttccccacacccagcatcaagtggctgcgccccagtggccccatgccagccgaccgagtcacctaccagaaccacaacaagaccctgcagctgctgaacgtggcagaggaggacgacggcgagtaccggtgcctggccgagaactcgctgggcagcgaccggcacacctactacgtcacggtggaggctgccccctactggctgcacaagccccagagccacctgtacggccccggagagactgcccgcctggactgccaagtgcaggggaggccccaacccgaggtcacctggaggatcaacgggattcctgtggaggagctggccaaggaccagaagtaccggatccagcgtggggccctgatcctgagcaacgtgcagcccagcgacacgatggtgacgcagtgcgaggctcgcaacaggcacgggctcctgctggccaatgcctacatctatgtcgttcagcttccggccaagatcctgacccctgacaacgagacgtacatggcggtcgagggcagcacggcctatcttctgtgcaaggcctttggagctcctgtgcccagtgtccagtggctcgacaaggaagggaagaccgtgctacaggatgaacgcttcttcccctacaccaacgggaccctgggcatccgggacctccaggccaatgacactggccactacttctgccaggctgccaacgaccagaacaacgtgaccattgtggctaacctgcaggtcaaagatgccactcagatcacacaggggccacagagtgcaatcgagaaaaaaggctcaaaagtgactttcacgtgccaggcctcctttgacccttccttgcagcacagcatcacctggcgaggggacggtcgaaacctccaggagtttggggacagtgacaagtacttcatagaggacgggcgcctggtcatccacagcgtggactacagtgaccagggcaactacagctgtgtggccggcaccgagctggacatggtggagggcagggcggagctgctggtggtggggagccccgggccggtgcctcacctggagctgtccgatcgccacctgctgaagcagagccaggtgcgcctgtcctggagacccgccgaggaccacaacgcccccatcgagaagtatgacattgaatttgaagacaaggagatggcgcctgagaaatggtacagtttgggcaaggtgcccgggaaccagacctccaccaccctcaagctgtcgccctacatccactacacctttagagtgacggccatcaacaaatacggccccggggagcccagcccagcctctgagactgtggtcacacccgaggcagccccagagaagaaccctgtggacgtgaagggggaagggaacgagaccagcaacatggtcatcacttggaagccgcttaggtggatggactggaatgccccccaggttcagtaccgcgtccaatggcgccctcaggggacacggggtgcctggcaggaacagatcgtgagcgaccccctcctggtcgtgtccaacacctccaccttcgtgccttatgagatcaaagtccaggccgtcaacagccagggcaagggccctgagccccagattaccatcggctactctggggaagattacccgcaggcaagccctgagatggaaggcatcaagatcctcaattcgagcgccgtgctggtccggtggtggcctgtggacccagcccaggtcaagggccacctccgaggatacaacgtgacgtactggtgggagggcagtcagaggaggcacagcaaaaggcatgtccacagaggccacgtggtggtggccgccaacaccaccagcgccgtcctggggggcctgaggccctacagctcctaccgtctggagttgagggccttcaatggccgaggactggggcccgccagcgagatgaccttcagcaccccggagggagtgccgggccaccctgaggcgctgcacctggagtgccagtcggataccagcctgctgctgcactggcagcccccgctcagccacaacggcgtgctcaccggctacgtgctctcctaccaccccctggacgacggggacaaggagcagctgtccttcgaccttccggaccccgagctgcggacacacaacctgaccaatctgagcccccacctgcgctaccgcttccagctgcaggccaccaccaaggagggccccggggaggccatcgtgcgcgagggaggcaccatggccttgtccgggaccccggattttggcaacatctcggccatggctggcgagaactacagcgtggtctcctgggtccccaaggagggccagtgcaacttcggcttccagatctggttcaaagccctgggggacgagaagatgggccctcacctgccgccgcagtacgtcagctacaaccagagctcctacacgcagtgggacctgcagcccgacaccgactatgagatccacctgctcaaggagcgggtgctgctgaagatggccgtgaagaccaacggcaccggccgcgtgaggctcccgcccgccggcttcgccacggagggctggttcatcggcttcatcagcgccatcattctcttgctgctcatcctgctcatcctctgctttatcaagcgcagcaaagggggcaaatactcagtgaaggataaggaggacacccaggtggactccgaggcccggccgatgaaggacgagaccttcggcgagtacaggtccctggagagtgacaacgaggagaaggcctttggcagcagccagccgtccctcaatggggacatcaagcccctgggcagtgacgacagcctggccgactacgggggcagcgtggacgtgcagttcaacgaggacggctccttcatcggccagtacagcggcaagaaggagaaggaggcagcaggcggcaacgacagctcaggggccgcctcccccatcaaccctgccggggccctagagtag

SEQ ID NO: 204 - DNA, 4998 bp, Bos taurus
cgcagtgccctcacccccggctccctcccacagccacccaccagccacccttccctccggccggagcttgagccaagcccggccggctttgccggcaaagccgagctgccggcgccgccgggaagatggccgtggcgctgtggttcttgtggcctctcctcctctgcagcccttgcgtgctcatccagatccctgaggaatatgaaggacaccatgtgatggaaccccccatcatcacggagcagtctccccggcgtgtggtcgtcttccccacagatgacgtcagcctcaagtgtgaggccagcggcaaacccgaagtgcagtttcgctggactcgggatggcatcctcttcaaacccagagaggaactgggcatgatcgtgaaccaggtgccccattctggctccttcagcatcacgggcaacagcagcaactttgcccagagcttccagggcacctatcgctgctttgccagcaacaagctgggcaccgccatgtcccacgagatccagctcatggccgagggtacccccaagtggccaaaggagacagtgaaacctgttgaggtcgaggaaggggagtcggtgattctcccttgccacccgccccccagtgcagagccactccggatctactggatgaacagcaagatcttgcacatcaaacaggatgagcgggtgaccatgggccagaatggcaacctctactttgctaatgtgctcacctcagacaaccactcagactacatctgtcacgcccacttccctggcacccgaaccatcattcaaaaggaacccattgacctccgggtcaaagcgaccaacagcatgatggacagaaaaccacacttgctcttccccaccaattccagcagccacctggtggccctgcaggggcagcccttgatcttggagtgcatagctgagggcttccccacgcccaccatcaagtggctgcgcccaagcggccccatgccagccgaccgggtcacctaccagaaccacaacaagacgctgcagttgctgaacgtgggtgaggaggacgacggcgagtaccgctgcctggctgagaactcgctgggcagcgaccgccacgcctactacgtcaccgtggaggctgcaccatactggctacacaagccccagagccatctgtacgggccaggggagactgcccgcctagactgtcaagtgcagggcaggccccaaccggaggtcacctggagaatcaatgggatccctgtggaggagctgggcaaggaccagaaataccggatccaccatggagccctggtcctgagcaatctgcagcccagtgacactatggtgacccagtgtgaggcccgcaaccgccacgggctcctgctggccaatgcctacatctatgttgtggagctgccagccaagatcctgaccccagacaatgagacatacatggcagtccagggcagcaccgcctaccttctgtgcaaggccttcggagcccctgtgcccagcgtccagtggctggacagggaaggaaagacagtgctgcaggacgagcgcttcttcccctacaccaacgggaccctgggcatccgagacctccagaccaatgacactgggcactacttctgccaggctgccaacgaccaaagcaacgtgaccattgtggctaacctgcaggtcaaagatgccactcggatcatgcaggggccccgcagtgcaatcgagaagagaggctcccgagtgatgttcacatgccaggcctcctttgacccctccctgcagcacagcaccacctggcgcagggatgctctcgacctgcaggagttgggggacagtgacaagtacttcatagaagacgagcgcttggtcatccacagcctggactacagtgaccagggcaactacagctgcgtggccagcaccaagctggacgtggtggagagccgggcagagctgctggtggtcgggagccccggacctgtgccccagctggagctgtctgatcaccacctgctgaagcagagccaggtgcgcctgtcttggagcccagctgatgaccataacgcccccattgagaagtatgacattgaatttgaggacaaggagatggcacccgagaagtggtacagcctgggcaaggtgcccggaaaccagacctccaccaccctcaagctgtcgccttatgtccactatacctttcgagtcactgccatcaacaaatatggccctggggagcccagcccggactctgagactgtggtcacgccggaggcagccccagagaagaaccccgtggacgtgaagggggaaggaaatgagaccaacaacatggtcatcacttggaagccgctgcggtggatggactggaatgccccccaggttcagtatcgagtgcagtggcgcccccagaagatgcagggggcctggcaggaacagatcgtcagtgaccccttcctggtggtgtccaatacatctacctttgtgccgtatgagatcaaagtccagaccgtcaacagccagggcaagggccctgagccccagatcaccatcggctactctggagaggactacccccaggcaagccctctgctggaacccgtcaaggccctcaattcaagcactgtgctggtcaggtggcagtctgtggacccagcccaggtcaaaggccacctccggggatacaatgtgacgtactggtgggaaggcagtcagaggaagcacaacaagaggcacgtccacaaaggccacgtggtggtgccagccaatgccaccagcaccatcctgggaggcctgcggccctatagctcctactgggtagaggttcaggcctttaacgggaggggactggggcctgccagtgggatgaccttcaacacccctgagggagtgcctggacaccctgaggcgttgcacctggagtgccagtcagataccagcctgctgctgcactggcagcctccgctcagccataatggtgtgctcacgggctacgtgctctcctaccaacctttgaatgacgggagcaaggagcagttgtcctttgacctcccggaccctgagctgcggacacacaacctgaccaacctcagcccccgcctgcggtaccgattccagctgcaggccaccacgagggagggcccgggggaggcgatcgtacgggaaggaggcaccatggccttgtccgggatgccggactttggcaacatctccgccatggctggcgagaattacagtgtggtctcctgggtccccaaagagggccagtgcaacttcgggttccagatctggttcaaagccctgggggacgagaagctggtggctcgtctcccaccgcagtacgtcagctacaaccagagctcctacacacagtgggacctgcagcctgacaccgactatgagatccagctgctcaaggagcaggtgctcctgcaccagatggcagtgaagaccaacggcaccggccgagtgaggctgcctcccgctggctttgccactgagggctggttcatcggcttcatcagtgccatcgttgtcctgcttcttgtcttactcatcctgtgcttcattaagcgcagcaagggtggcaagtactcggtgaaggacaaggaggacacccaggtggactcagaggcccggcccatgaaggacgaaaccttcggcgagtacaggtccctggagagtgacaatgaggagaaggcctttggtagcagccagccatcactcaacggagacatcaagcccctgggcagcgatgacagcctggcggactacggaggcagcgtggacgtccagttcaatgaggatggctccttcatcggccagtacagtggcaagaaggagaaggaggtggcagggggcaatgacagctccggggccacatcccccatcaaccccgccgggaccctggagtagcggggtccagccaggccaggcagagcaccacccagggccaggccacggggctatcagagatcaccatgatggcccagcccaaggcctgtgctgggtccctgaccctgggactgaggcccgtccttctctccagtgagttcgggggccgaggaggggatctcgctgcctcaacgccctcttctgactccccagtccccacttgattgccaaaacccagctgctctgcttcttgggcacacactgctttttcactccagctcgggggccactcacatgccaggagtcttcaggtgctgcctcaccagcctttgggcagggcgaggctgtggttgaggcgaggaggcaggcacagctgtggagggggtctcctaaggaccagggttggcacctccagccccagccactcgttggccagtaggactgggacaggggactgaagtcggtgtccctgctgtctgccccatcttctcagccatctctgctccaactgggatgggaactgaacaagctggccacgggtacagagggggccatctgaacagaccagagtccccccaccactgcctgtgtcaacttggcccaccccaccctgcagctggctttcaggagttccagacacatgctgccttcggtgcccaccagaaaacatccaagtgggctccgctgtccctgcccaggcccacctcctcccccggccccaggaccccttagcaacccacccccccaaccccagtctgaacttgttcagccccttgctcagcgatcccccccagcgccccgccttggaaatgtaaatacaccacgactttgcaagtttgtgccctcgccctttccccatatgccactagtgtgtaggcagatgtctgagtctgtaggtggtttctaggttttctagcaattagctttgatgatcccatcccaggaaaaaagaaaaacagacaaaaaaaaaaaaaaaggaaagatcagttctcccagcagccaccatcgccctgaatgcctttgcttggtctgtcgatgagccctttacaaaaaaaaagtatatatatatatgtacataaatatcagaattataaaaggcaaataaaaacctggaaacaaa

SEQ ID NO: 205 - DNA, 5288 bp, Mus musculus
ttccccgcgcacgctgccccgcccgccgccgccgccgccgcagcagcagcagcagcaacatcgcgtcggcagcggcatcgctgggtggcaggtccgaggtcggcgtgcacagagactgagctggcaacctgatcggcgcagtacgccccccccccgcccctgtcagcagctaccgctggaaacaaaccaccagcaggagggtgagtggaatctggctagttgtgctgcaccgagctgctgagctgacagcaagatggtcgtgatgctgcggtacgtgtggcctctcctcctctgcagcccctgcctgctcatacagattccagacgaatataaaggacaccatgtgctagagccacctgtcatcacggaacagtctccacggcgcctggttgtcttcccaacagatgacataagcctgaaatgtgaagccagaggcagaccccaagtggagttccgctggacgaaagatggcatccacttcaaacccaaggaagaattgggtgtagtggtgcatgaggcaccctattctggctccttcaccatcgaaggcaacaacagctttgcccagaggtttcagggcatctatcgctgctatgccagcaataagctaggaactgccatgtcgcatgagatccagctcgtggccgagggtgcccccaagtggccgaaggagactgtaaaacctgtggaagtggaggaaggagaatcagtagttctgccttgcaaccctccacccagtgcagccccacttaggatctactggatgaacagcaagattttgcacatcaaacaagatgagcgggtgtccatgggccagaatggagacctatattttgccaatgtgcttacctcagacaatcattcagactacatctgcaatgcccacttccctggtacccggaccatcattcaaaaggaacctattgacctccgggtcaagcccaccaacagcatgattgaccggaagccacgtctgctctttcccacaaactccagcagccgcctggtagccttgcagggccagtcattgatcctggagtgcattgctgagggattccctacacccaccatcaagtggctgcaccccagtgacccaatgccaacagaccgtgttatctaccaaaaccacaacaagaccctgcaactactcaatgtgggcgaagaggacgatggcgagtatacctgccttgctgagaactcgctgggcagtgcccggcatgcctactatgttactgtggaagctgccccatattggctgcagaagccccagagccatttgtatggtccaggagagactgcccgcctagactgccaagtccagggcaggccccaaccagagatcacttggagaatcaacggaatgtctatggagacggtgaacaaggaccagaagtaccggattgagcaggggtctctgatcttgagtaacgtgcagccaagtgacacaatggtgacccagtgtgaagcccgcaaccagcatgggctcctgctagccaatgcctacatttatgttgtccagctgccagccaggatcctaacaaaagacaatcagacatacatggcagttgagggcagtactgcttacttgctgtgcaaagcctttggagctcctgttcccagtgtccagtggctggatgaagaaggaaccacagtgcttcaggatgaacgatttttcccctatgccaatggaacgctgagcatcagagacctccaggccaatgacactggacgctatttctgccaggctgccaatgaccagaacaatgtgaccattttggctaacctacaggttaaagaagcaacccagatcacacaggggccccggagcgcaattgagaagaaaggtgcaagggtgacattcacgtgccaggcctcctttgacccctctttgcaggccagcatcacttggcgtggagatgggagagacctacaggaacgtggggacagtgacaagtatttcatagaagatgggaaactagtcatccagagcctggactacagtgaccagggcaactacagttgtgtggccagcactgaactggatgaggtggagagcagggcacagctcttagtggtggggagccctgggccagtgcctcacctggagctgtccgaccgccacctgctgaagcagagccaggtgcacttgtcttggagccctgctgaagaccacaactctcccattgagaagtatgacattgaatttgaggacaaggaaatggctcctgagaaatggttcagtctgggcaaggtgccaggaaatcagacctctactaccctcaagctgtccccctatgtccactacacctttcgggtcactgccattaacaaatatggtcctggagaacccagccctgtctctgagactgtggtcacacctgaggcagccccagagaagaaccctgtggatgtgagaggggaagggaatgagaccaacaatatggtcatcacatggaagccccttcggtggatggattggaatgccccccagattcagtaccgtgtacagtggcgtccacagggcaagcaggagacctggagggaacagaccgtgagcgaccctttcctggtggtgtctaacacttccacatttgtgccttatgagatcaaagtccaggcagtgaacaaccagggcaagggccctgagccccaggtcaccattggctattcaggggaagactacccccaggtgagccctgaacttgaagacatcacaatcttcaactcaagtactgtgcttgtcaggtggaggcctgtggacttggcccaggttaagggccacctcaagggatacaatgtaacatactggtggaagggcagccagagaaagcacagcaagaggcatatccacaaaagccacatagtggtacctgcaaataccaccagtgccatcctcagtggtttgcgcccttacagctcttaccatgtggaggtacaggcctttaatgggcggggcttggggcctgcgagtgaatggaccttcagcaccccagagggagtgcctggccaccctgaggcattacacctggagtgtcagtcggacactagtctgctactgcactggcagccaccactcagccacaatggagtgctcactggctacctgctctcttaccatcccgtggaaggggaaagcaaagagcagttgttcttcaacctttcggacccagaactccggactcataatctgaccaacctcaaccctgatctacagtaccgcttccagcttcaggccaccacccaacagggtcctggtgaggccatcgtgcgtgaaggaggcaccatggccctgtttggcaagccagattttggcaacatctcagccacagcaggtgaaaactacagcgtggtctcctgggtccctcggaagggccagtgcaatttcaggttccatatcttgttcaaagccttaccagaagggaaagtgagccctgatcaccagcctcagcctcagtatgtcagctacaatcagagctcctacacacaatggaacctacagcctgacaccaaatatgagatccacctgataaaggagaaggtcctcctgcaccatctggatgtgaagactaatggaactggccctgtgcgagtttctactacaggtagctttgcctccgagggctggttcatcgcctttgtcagcgctatcattctcttgctcctcatcctgctcatcctctgcttcatcaaacgcagcaagggtggcaaatactcagtgaaggacaaggaggacactcaggtagattccgaggcccggcccatgaaagacgagaccttcggcgagtacaggtccctggagagtgacaatgaagagaaggcctttggcagcagccagccatctctcaacggagacatcaaacccctaggcagtgatgacagcctggctgattatgggggcagtgtggacgtccagttcaatgaggatggctctttcatcggccagtacagtggcaagaaagagaaggaggcagcaggaggcaatgacagttcaggggctacctctcctatcaatcctgcagtagccctagaatagcaaggtccagccatgtgaggcagggccaagctgggcccagggccagaggtgcaggagagcccaggggccaagacacctggccaatgtagtgcaccatgccactggcctgctgactttgggatcgaggtccttccttctctccacagcgcatggaagacttgactggagcagaggagaggaactgtggcttcgagtctctttcttaccacccgctaccctctttattgccaaaacccagctgcaccctttcctgggcatacgctgctttgccccagctcggggcagttcactcccatatcagggatcttcaggtgctgccttgccgacccatttagacagagaggccacagtttgagggaaaagacaaaggagagtcctctgagtcatctctgagaagctgccctcactttctgactggaaacaggcacggtggggtctcctcaggactaggttggcacctcttctttctccctggctagcctgactggagacaaaactctgtccccaccatctgctcccttttctttgccatttttgatccaatcaggatggggacctgagcaagctggccacctgtgtagaagaggccatctggaaaacccagagttgtcccccacccccttagcacactaggttcgcaccctcctcccattgctattccacctttcaggacacacacacacacacacacacacacacacacacacacacacactcacttattcatattgccttcaatacccatcagacaacatcgaagtggcttctctcactgttggagataggcacacctcttcctacaggcactggctaggcttctccctgctgccaccataccccagaaccccttagcagccctgcctgcccccagttctcatcctctgccccttcccctgtccctcacgttgggaatgtaaatacaccgtgactttgaaagtttgtgccgttgccctttccccatatgccactagtgtgtaggcagatgtctgagtctctaggtggtttctccattttatagcagttagctttgatgaccctactccacgaaaaataaaagcagacaaaaaaaaaaaaaaaaaaaaaaagcaaagattggctcccagcactctgctgtgctcctgtccagcagctgtggcttccctgtatgcttttgcttggtctgttgatgagccctctacaaaaaaataaacaaacaaaaattatatatatgtatataatatcagaattataacaggcaaataaaaacctagaaatg

SEQ ID NO: 206 - DNA, 5093 bp, Rattus norvegicus
cccacccccgtcagcaggtaccgctggaaccaaccaccagtgagagggtgagtggaatctggccagttgtgctgcactgatctgctgagctgacaggaagatggtcatgatgctgtggtacgtgttgcctcttctcctctgcagcccctgcctgctcatacagattcctgatgaatataaaggacaccatgtactggagccacctgtcatcacagaacagtctccacggcgcctggttgtcttcccaacagatgacataagcctcaaatgtgaagccagaggcagaccccaagtggagttccgctggacgaaagatggcatccacttcaaacctaaggaagaattgggtgtagtggtacacgaggcaccctattctggctccttcaccatcgaaggcaacaacagctttgcccagaggtttcagggcatctatcgctgctatgccagcaataatctaggaactgccatgtcgcatgagatccagctcgtggctgagggtgcccccaaatggccgaaggagactgtaaaacccgtggaagtggaggaaggagaatcagtagttctaccttgcaatcctccacccagtgcagccccacttaggatctactggatgaacagcaagattttgcacatcaaacaagatgagcgggtgtccatgggccagaacggagacctatattttgccaatgtgcttacctcagacaatcattcagactacatctgcaatgcccacttccctggcacccggaccatcattcaaaaggaacctattgacctccgggtcaagcccaccaacagcatgattgaccggaagccacgcctgctcttccccacaaactccagcagtcacctcgtggccttgcagggccagtcattaatcctggagtgcattgctgagggattccctacacccaccatcaagtggctgcaccccagtgaccctatgccaacagaccgtgttatctaccagaaccataacaagacactgcagctcctcaatgtgggcgaggaagatgatggcgagtatacctgccttgctgagaactcactgggcagtgctcggcatgcctactatgtcactgtggaagctgccccatactggctgcagaagccccagagtcatttgtatgggccaggagagactgcccgcctagactgccaagtccagggcaggccccaaccagaggtcacctggagaatcaacggaatgtctatagagaaggtgaacaaggaccagaagtaccggattgagcaggggtctttgatcctgagtaatgtgcaaccaagtgacacaatggtgacccagtgtgaagctcgcaaccagcatgggctcctactagccaatgcctatatctatgttgtccagctgccagccaggatcctaacaaaagacaatcagacatacatggcagtagagggcagtactgcttacttgctgtgcaaagcctttggagctcctgttcccagtgtccagtggctggatgaggaaggaaccacagtgcttcaggatgaaagatttttcccctatgccaatggacacctgggcatcagagatctccaggccaatgacactggacgctatttctgccaggctgccaatgaccagaacaatgtgaccattttggctaacctacaggttaaagaagcaacccagatcacacaaggaccccggagcacaattgagaagaaaggtgcaagggtgacattcacgtgccaggcctcctttgacccctctttacaagccagcatcacttggcgtggagatgggagagacctccaggaacgtggagacagtgacaagtatttcatagaagatgggcaacttgtcatcaagagcctggactacagtgaccagggagactacagttgtgtggccagcactgaactggatgaggtggagagcagggcacaactcttagtggtgggaagccctgggccagtgcctcacctggagctgtccgaccgccacttgctgaagcagagccaggtgcacttgtcttggagccctgctgaagaccacaactctcccattgagaaatatgacattgaatttgaggacaaggaaatggctcctgagaaatggttcagtctaggcaaggtgccaggaaatcagacctctactaccctcaagctgtccccctatgtccactacacctttcgggtcactgccattaacaaatatggtcctggagaacccagccctgtctctgagactgtagtcacacctgaggcagccccagagaagaaccctgtggatgtgagaggggaaggaaatgagaccaacaatatggtcatcacatggaagccccttcggtggatggattggaatgccccccagattcagtaccgtgtacagtggcgaccactgggcaaacaagagacctggaaggaacagaccgtgagcgaccccttcctggtggtgtctaacacttccacatttgtgccttatgagatcaaagtccaggcagtgaacaaccaggggaagggccctgagccccaggtcaccattggctattcaggggaagactacccccaggtgagccctgagcttgaagacatcacaatcttcaactcaagcactgtgctggtcaggtggaggcctgtggacttggcccaggttaagggccacctcaggggatacaatgtaacgtactggtggaagggcagtcagagaaagcacagcaagaggcatgtccacaaaagtcacatggtggtacctgcgaacaccaccagtgccatcctcagtggtttgcgtccttacagctcttatcatgtagaggtacaggcctttaatgggcggggcttagggcctgcaagtgaatggaccttcagcaccccagagggagtgcctggccaccctgaggcattacatctggagtgccagtcggacactagcctgctactgcactggcagccaccactcagccacaatggagtgctcactggctacctgctctcttaccatcccttggatggggaaagcaaagagcagttgttcttcaacctttcggacccagagctccggactcataatctcaccaacctcaaccctgatctacagtaccgcttccagcttcaggccaccacccatcagggtcctggtgaggccattgtgcgtgaaggaggcactatggccctatttggcaagccagattttggcaacatttcagtcacagcaggtgaaaactacagtgtggtctcctgggtccctcgggagggccagtgcaatttcaggttccacatcctgttcaaagccttgccagaagggaaagtgagccctgatcaccagcctcagcctcaatatgtgagctacaatcagagctcctacacacagtgggacctacagcctgacaccaaatatgagatccacctgatgagggagaaggtcctcttgcaccatctggctgtgaagactaatggcactggccccgtgcgagtttctactacaggtagctttgcctccgagggctggttcatcgcctttgtcagtgctatcattctcttgctcctcatcctgctcatcctctgcttcatcaaacgcagcaagggcggcaaatattcagtgaaggacaaggaggacactcaggtagattccgaggcccggcccatgaaagacgagaccttcggcgagtacagtgacaatgaagagaaggccttcggcagcagccagccatctctcaatggagacatcaaacccctaggcagtgatgacagtctggctgattatgggggcagtgtggatgtccagttcaatgaggatggctctttcatcggccaatacagtggcaaaaaagagaaggaggcagcgggaggcaatgacagctcaggggctacctctcctatcaatcctgcagtagccctagaatagcaaggtccagtcatgtgaggcaggaccaagctgggcccagggccagaggtgcagaagagccaggggccaagacacctggccaatgcaccatgccattggcctgctgactttgggatcgagggtccttccttctttccacagaggcatggaagacttgactggaggcagagaggaactgtgacttcgagtctctttcttaccacctgctaccctctttattgccaaaacccagctgcaccctttcctggcgatacgctgctttgcccgctcagggcagttcactcccatatcagggatcttcaggtgctgccttgccgacccatttagacagagaggccatagtttgtgggagaagacaaaggagagtcctctgagccatctctgagaagctgtcctcactttctgactggaaacaggcatggtggggtctgttcaggactagcttggcacctcttctttctccctggctagcctgactggagacagaactctgtccccaccatctgctccctttgccatttttgatccaatcaggatggggacctgagcaagctggccgcctgtgtagaagaggccatctggaaagcccagagtcgtcccccacccccttagcacactagtttacaccctcctcccattgctattccactttcaggacacacacacacacacacacacacacacacacacttactcatattgccttcgatacccaccagagaacatcgaagtggcttctctcactgctggagataggcagacctcttcctactggaattggctagacttttccctgctgccaccataccccaggaccccttagcagccctgcctgcccccagttcttgtcctcagccccttcccctgttcctcacgttgggaatgtaaatacaccgtgactttgaaagtttgtgctgttgccctttccccatatgccactagcttgtaggcagatgtctgagtctctaggtggtttccccattttatagcagttagctttgatgatctcactccaagaaaaataaaagcagacacacacacaaaaaagcaaagattgcgtgtcccagcactgctgtggttcgctcagcagctgtgctcttcctgtatgcctttgcttggtctgttgatgagccctctacaaaaaacaaatatatatatatgtacataatatcagaatataacaggcaaataaaaacctggaaatgaaaaaaaaaaaaaaaaaaaa

SEQ ID NO: 207 - DNA, 2908 bp, Homo sapiens
cgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcaaaaaaaaaaaaa

SEQ ID NO: 208 - DNA, 2906 bp, Pan troglodytes
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttgcctcccccgagaactttccccccttctcctccctgcctctaactccgatccccccacgccatctcgccaaaaaaaaaaaaaaaaaaaaaaaaagaaaaaaagaaaaaaaaaaaagaaaaaaaattaccccaatccacgcctgcaaattcttctggaagaattttcccccctcgcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagctgaatgcggcgaagactctggacagcgagggcacagggtcccaaaccgaggccgcgccaagatggcagaggatggaggctccttcatcaacaagcgaccctcgtctaaagaggcagctgagtgagagagacagagagaaggagaaagagggagggagagagagaaagagagagaaagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggactttttttttttttttttgcacttcgctgtgtttcccccccatctttaaaaataattagtaataaaaaacgaaaattccatatctagccccatcccacacctgtttcaaatccttgaaatgcatgtagcagttgttgggcgaatggtgtttaaagaccgaaaatgaattgtaatttgcttttccttttaaagacaggttctgtgtgctttttattttgatttttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagagtcaggacttgtactgggaaaaaaaaaccctaaattaattatatttcttggacattccctttcctaacatcctgaggcttaagaccctgatgcaaacttctcctttcagtggttggagaaattggccgagttcaaccattcactgcaatgcctattccaaactttaaatctatctgttgcaaaacctgaaggactgtagttagcggggatgatgttaagtgtggccaagcacacggcagcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcagagta

SEQ ID NO: 209 - DNA, 1063 bp, Canis lupus
tttttttcccccctctctccaggttgggcgcgtttggtgcaagattctcgggatcctcggcgttgcctcctctccctcccccctcccccctcctttccttttcctttcctttctttcttcctttcctccccccacccccaccccaaacaaacaagtccccaattcccgtccgtgctcgccgcgggcagcgggcggcggaggcagcgcgccgcggtcgccgggagccgggagcctcgggcgcccgctcctcggcgcagcatgttccagccggcgcccaagcgctgcttcaccatcgagtcgctggtggccaaggacagtcccctgcccgcctcgcgctccgaggaccccatccgtcccgcggcgctcagctacgccaactccagccccataaacccgttcctcaacggcttccactcggccgccgccgccgccgccgccggcaggggcgtctactccaacccggacttggtgttcgccgaggcggtctcgcacccgcccaaccccgcggtgcccgtgcacccggtgccgccgccgcacgccctggccgcccaccccctgccctcctcgcactcgccacaccccctcttcgcctcgcagcagcgggacccgtccaccttctacccctggctcatccaccgctaccggtatctgggccatcgcttccaagggaacgacacaagcccggagagcttccttttgcacaacgcgctggcccgaaagccgaagcggatccgaaccgccttttccccgtcccagcttctgaggctggaacacgccttcgagaagaaccactacgtggtgggcgccgagaggaagcagctggcgcacagcctcagcctcacggaaactcaggtaaaagtatggtttcagaaccgaaggacgaagttcaaaagacagaagctggaggaagaaggctcagattcgcaacaaaagaaaaaagggacgcaccatattaaccggtggaggatcgccaccaagcaggcgagtcccgaggaaatagacgtgacctcagacgattaaagacataaaccgcaccccactgaacggacaacacggagcaaaa

SEQ ID NO: 210 - DNA, 2219 bp, Bos taurus
gcagcgggcagcgggcggcggaggcagcgcgccgcggtcgccgggagccgggagccccgggcgcccgctccttggcgcagcatgttccagccggcgcccaagcgctgcttcaccatcgagtcgctggtggccaaggacagtcccctgcccgcctcgcgctccgaggatcccatccgtcccgcggcgctcagctacgccaactccagccccataaacccgttcctcaacggcttccactcggccgccgccgccgctgccgccggcaggggcgtctactccaacccggacttggtgttcgccgaggcggtctcgcacccgcccaacccggccgtgccagtgcacccggtgccgccgccgcacgccttggccgcccaccccctgccctcctcgcactcgccacaccccctcttcgcctcgcagcagcgggacccgtccaccttctacccctggctcatccatcgctatcgatatctgggccaccgcttccaagggaacgacgcaagcccggagagcttccttttgcacaacgccctggcccgaaagccgaagcggatccgcaccgccttttccccgtcccagcttctgaggctggaacacgccttcgagaagaatcactacgtggtgggcgccgagaggaagcagttggcgcacagcctcagcctcacggaaactcaggtaaaagtatggtttcagaaccgcaggacgaagttcaaaaggcagaagctggaggaagaaggctcagattcgcaacaaaagaaaaaagggacgcaccatattaaccggtggaggatcgccacaaagcaggcgagtcccgaggaaatagatgtgacctcagacgattaaaaacacagacagaaccccaccgaaacggacatcacagagcaaaacagagacagggagaggaggggaagacgaaaaaaaaaaagaaaacaaaaaaccctacaaaacaaaaacaaccgcacacacacattcacggagaaggggacagggagtcagagagaggagccgcggcgcgacgtagacgggcggcagaaccagggtcctcatccgaggccgcgcctcgatggcagaagacgggaggctccttgatgaacacgctacccttgtctaaagaggcagctgagtgagtgagtgaggcagaaagagagagagagagagaggtcctaaggtggcaaagccgaaggcgctctgacaaggggagctgtcagtcaaacgccaaaccagcgagacaagatgattggcaggtattccgtttatcacagtccgattttttttttaaatgatgatgataatggtgatgataaaagaaaaaaaaaaacccaaccaggcacaggacttttaaattttgcccttcgaagtgtttttttccccccaatctttaaaaataatgagtaataatcgagattccatatccagccccatcccacacctgttcaaaaacttgaattgcatgtagcagttgttgggcgaatggtgtctaaagacagaaaatgaattgtaattttcttttccttttaaagacaggttctgtgtgtttttattttgattttttttttcaagaaacgtgcagtctgtaaacactttttgataccttctgatgtcaaagtgattgtgaaagctaaatgaggtaggctcagcaatagtggtcctctttcagagaaatggggaacaggatggggggctgggggtggagggggagggtgcccataagaggagtcagaacttgttctgggaaaagaaacaacaaaaaatctaaattctatttcttggacattccctttcctaacatgccgaggcttaaaaccacgaagtaaacttctccttttagtcattgaagatattggctgagttcaaccatttgccgtaaaggccattccaaactttaaatctatatattgcaaaaactgaaggactgtagttagcggggatgatgttaagtgtggccaaggacactgcggcaagttttcaagcactgagtttctatttcaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcaaaaaaaaaaaaaaaaaaaaaaaaaaaaaaaaaaaaaaaaaaaaaaaaaaaaaaaaaaa

SEQ ID NO: 211 - DNA, 2598 bp, Mus musculus
aggcttcggaggaagctgtttatgtgatccccgcactaattaggctcatgaactaacaaatcgtttgcactactagtgaagaagcgaacacttccatggattgtccttggacttagggcgccctgcccgccttttgcaaaggagagaaaactttttttttgcctccccgaaaaccccctccctgcctctaactccaatctcccccccccccacgccacctcgctcaaaaaaatattaccccaatccacgcctgcaaattcttctggaaggattttcccccctctctccaggttgggcgcgtttggtgcaagattctcgggatcttcggctttgcctctcctccccctccccctcctttcctttttcctttcctttcttccttccttcctttccttacccccacccccaccccaaacaaacgagtcccccattctcctcggtcctcgccgcgggcagcgggcggcggaggcagcgcgccgcggtcgccgggagcagggagcccagcgcgcccgctcctcggcgcagcatgtttcagccggcgcccaagcgctgcttcaccatcgagtcgctggtggccaaggacagtcccctgcctgcctcgcgctccgaggatcccatccgtcccgcggcactcagctacgccaattccagtcccataaatccgttcctcaacggcttccactcggccgccgccgccgccgccgccggcaggggcgtctactccaacccggacttggtgttcgccgaggcggtctcgcacccgcccaaccccgccgtgccggtgcacccggtgccgccgccgcacgccctggccgcccaccccctgccctcctcgcattcgccacaccccctcttcgcctcgcagcagcgggacccgtccaccttctacccctggctcatccaccgctaccgatatctgggtcatcgcttccaagggaacgacacaagtcccgagagtttccttttgcacaacgctctggccagaaagccaaagcggattcgaaccgccttctcgccgtcccagcttttaaggctagagcacgcttttgagaagaaccattacgtggtgggagcggaaaggaagcagctggctcacagtctcagtcttacggaaactcaggtaaaagtatggtttcagaaccggagaacgaaattcaaaaggcaaaagctagaggaagaaggctcagattctcaacagaagaaaaaagggacacaccacattaaccggtggagaattgctaccaagcaggcgagtccggaggaaatagatgtgacctcagacgattaaaagtccaaacccaatcctacaaaaatggacagcacagagcaagaaagacagggagaggaggggaagaaaaaccctacaaaacaaaaacaaactgcacacacatccaccgagaaagggagagagggaatcagagcagtgacgctcgcagcagactttggacagcgagggcactggaccgggaaccggcgccgggccgggcaccgcttacaggacagcagaggacggaggcccgatcatcaacatgcaaccctcgtctaaagaggcagctgagtgagtgagagagacagagactgggagggagagagaggaatgagagagagagagagagagaatgaatgatccttgtgaggcaaaggcacattctgacaaggggagctgtcagtcaaatgccaaaccagggaaacaagatgattggcgggtattccgcttatcgaagtccatttagaaatgataatgatttttttttttggaaaaaaaaaggcacaggacttttaattttgcacttcacagtgtttccccctcatctttaattagaaataacatacaaaattccatgtctagccccatcctacacctgtttcaaaacttgaattgcatgtagcagttgtcgggcgaatggtgtctaaaaactgaattgtaattttattcctcttttaaagacaggttctgtgtatttttattttttattttttttctgagaaatgttcagtctgtaaaaacacttttttgataccttctattgtcaaagtgattgtgaaagctaaacgaagtaggctcggagatagtggtcctctgacagagaaatgagggagcaggactgggatggagggcgggggagggtgcccctgagaagaatcaggactcatgctaggggtaaaaacaacccacgataaaagacccaaattaattctatttcttggatatttcctttcctaacattctgatactttaaatcaccaagtcaacttttccttttagtggttggagagattgactgcatccagccactcatcataatggccattcagaacttttaagtctgtctattgcaaaagtggaaggaaggactgtatttaatggggtgatggtggcgtggccaaggacatgggagttttcaagcactgagtttctcttccaagaccatagacttactaaagagggttacaaatgcttccttagtgtcttctataccagattgtaaatatttttgtgttttgtgttaatttgttagaattctaacacactatatacttccaagaagtatgtcaatgtcaatattttgtcaataaagatttatcaatatgccctca

SEQ ID NO: 212 - DNA, 2946 bp, Rattus norvegicus
gagcaggaggaggagaggaacgaggaagaggaggagaagagggaagcggaggagcccaaggaggaggagagaaactgcagcgggtgccgcgagagcgagggagctagcccggagcgcagggcgaagacaccaagaggtctgcggccgggcgggcggctggaggcacggccggggcagtggcgccgactccgttccattctgggaccggatccaggcctccgggttcccaggcgttcgcctccctctgacgcactttaaagagtctcccccccttccacctcagggcgagtaatagcgaccaatcatcaagccatttaccaggcttcggaggaagctgtttatgtgatccccgcactaattaggctcatgaactaacaaatcgtttgcactactagtgaagaagcgaacacttccatggattgtccttggacttagggcgccctgcccgccttttgcaaaggaaagaaaacttttttttgcctccccgagaacccccctccctgcctctaactccaacccccccccaacgccacctcgctcaaaaaaatattaccccaatccacgcctgcaaattcttctggaaggattttcccccctctctccaggttgggcgcgtttggtgcaagattctcgggatcttcggctttgcctctcctccccctccccctcctttcctttttcctttcctttctttcttccttcctttcttttccttacccccacccccaccccaaacaaacgagtcccccattctcctcggtcttcgccgcgggcagcgggcggcggaggcagcgcgccgcggtcgccgggagcagggagcccagggcgcccgctcctcggcgcagcatgtttcagccggcgcctaagcgctgcttcaccatcgagtcgctggtggccaaggacagtcccctgcctgcctcacgctccgaggatcccatccgtcccgcggcgctcagctacgccaattccagccccataaatccgttcctcaacggcttccactcggccgccgccgccgccgccgcgggcaggggcgtctactccaacccggacttggtgttcgccgaggcggtctcgcacccgcccaaccccgccgtgccggtgcacccggtgccgccgccgcacgccctggccgcccaccccctgccctcctcgcattcgccacaccccctcttcgcctcgcagcagcgggacccgtccaccttctacccctggctcatccaccgctaccgatatctgggtcatcgcttccaagggaacgacacaagtcccgagagtttccttttgcacaacgctctggctcgaaagccgaagcggattcgaaccgccttctctccgtcccagcttttaaggctagaacacgcgttcgagaagaatcattacgtggtgggagcggaaaggaagcagctggcgcacagtctcagccttacggaaactcaggtaaaagtatggtttcagaaccggagaacgaaattcaaaaggcaaaagctagaggaagaaggctcagattcccaacaaaagaaaaaagggacacaccacattaaccggtggagaattgctaccaagcaggcgagtccggaggaaatagacgtgacctcagacgattaaaagtacaaacctattcccacagaaatggacagcacggagcaagagagacagggagaggaggggaagaaaaaccctacagaacaaaaaacaaactgcacacacattcaccgagaaagggggagagggaatcacagcagactttggacatcgagggcactggaccgggacccggcgctggggcaccactcacgggacaggaacggcagaggaccgaggccccttcatcaacatgcaaccctcgtctaaagaggcagctgagtgagtgagagagacagagactgggagggagagagaaaggagagagagagagagagagagagagagagagagagagagagagagagagaatgagaatgaatgatctggtccttctgaggcaaaggcacattctgacaaggggagctgtcagtcaaatgccaaaccagggaaacaagatgattggcggcgtattccgcttatcgaagtccatttagaaatgataatgattttttttttggaaaaaaaaggcacaggacttttaattttgcacttcgcagtgtttctccctcatctttaattagaaataacatgcaaaattccatgtctagccccaccctacacctgtttcaaaaacttgaattgcatgtaacagttgttgggcgaatggtgtctaaaaactgaattgtaattttactcttcctttaaaggcaggttctgtgtatttttattttttattttttctgagaaatgtgcagtctgtaaaaacactttttttttgataccttctattgtcaaagtgattgtgaaagctaaatgaagtaggctcggaaatagtggtcctctgacagagaaatgagggagcaggatggggatggagggcgggggagggtgcccctgagaagagtcaggacttacactaggggttaaaaacaacacatgataaagacccaaattaattctatttcttggatatttccttttctaacattctgattctttaaatcaccaaatcaacctttccttttagtggttggagacattgaccgcattcaaccactcaacacaatggccattcagaacttttaagtctgtttattgcaaaagtggaaggaaggactgtagttaatggggtgatagtggcgtggccaaggacatgggagttttcaagcactgagtttctcttccaagaccatagacttactaaagagggttacaaatgcttccttagtgtcttctataccagaatgtaaatatttttgtgttttgtgttaatttgttagaattctaacacactatatacttccaagaagtatgtcaatgtcaatattttgtcaataaagatttatcaatatgccctca

SEQ ID NO: 213 - DNA, 2368 bp, Homo sapiens
gcggtgccgcccgccgtggccgcctcagcccaccagccgggaccgcgagccatgctgtccgccgcccgcccccagggttgttaaagccagactgcgaactctcgccactgccgccaccgccgcgtcccgtcccaccgtcgcgggcaacaaccaaagtcgccgcaactgcagcacagagcgggcaaagccaggcaggccatggggctctgggcgctgttgcctggctgggtttctgctacgctgctgctggcgctggccgctctgcccgcagccctggctgccaacagcagtggccgatggtggggtattgtgaacgtagcctcctccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctgtacggcaaccgcggcagcaaccgcgcttcgcgagcggagctgctgcgcctggagccggaagacccggcccacaaaccgccctccccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaaacgctctcctcgagccctcccccaaacagactcgctagcactcaagacccggttattcgcccacccgagtacctccagtcacactccccgcggttcatacgcatcccatctctcccacttcctcctacctggggactcctcaaaccacttgcctggggcggcatgaaccctcttgccatcctgatggacctgccccggacctacctccctccctctccgcgggagaccccttgttgcactgccccctgcttggccaggaggtgagagaaggatgggtcccctccgccatggggtcggctcctgatggtgtcattctgcctgctccatcgcgccagcgacctctctgcctctcttcttcccctttgtcctgcgttttctccgggtcctcctaagtcccttcctattctcctgccatgggtgcagaccctgaacccacacctgggcatcagggcctttctcctccccacctgtagctgaagcaggaggttacagggcaaaagggcagctgtgatgatgtggaaatgaggttgggggaaccagcagaaatgcccccattctcccagtctctgtcgtggagccattgaacagctgtgagccatgcctccctgggccacctcctaccccttcctgtcctgcctcctcatcagtgtgtaaataatttgcactgaaacgtggatacagagccacgagtttggatgttgtaaataaaactatttattgtgctgggtcccagcctggtttgcaaagaccacctccaacccaacccaatccctctccactcttctctcctttctccctgcagccttttctggtccctcttctctcctcagtttctcaaagatgcgtttgcctcctggaatcagtatttccttccactgtagctattagcggctcctcgcccccaccagtgtagcatcttcctctgcagaataaaatctctatttttatcgatgacttggtggcttttccttgaatccagaacacaaccttgtttgtggtgtcccctatcctccccttttaccactcccag

SEQ ID NO: 214 - DNA, 1185 bp, Pan troglodytes
caactgcagcacagagcgggcaaagccaggcaggccatggggctctgggcgctgttgcctggctgggtttctgctacgctgctgctggcgctggccgctctgcccgcagccctggctgccaacagcagtggccgatggtggggtattgtgaacgtagcctcttccacgaacctgcttacagactccaagagtctgcaactggtactcgagcccagtctgcagctgttgagccgcaaacagcggcgtctgatacgccaaaatccggggatcctgcacagcgtgagtggggggctgcagagtgccgtgcgcgagtgcaagtggcagttccggaatcgccgctggaactgtcccactgctccagggccccacctcttcggcaagatcgtcaaccgaggctgtcgagaaacggcgtttatcttcgctatcacctccgccggggtcacccattcggtggcgcgctcctgctcagaaggttccatcgaatcctgcacgtgtgactaccggcggcgcggccccgggggccccgactggcactgggggggctgcagcgacaacattgacttcggccgcctcttcggccgggagttcgtggactccggggagaaggggcgggacctgcgcttcctcatgaaccttcacaacaacgaggcaggccgtacgaccgtattctccgagatgcgccaggagtgcaagtgccacgggatgtccggctcatgcacggtgcgcacgtgctggatgcggctgcccacgctgcgcgccgtgggcgatgtgctgcgcgaccgcttcgacggcgcctcgcgcgtcctctacggcaaccgcggcagcaaccgcgcttcgcgggcggagctgctgcgcctggagccggaagacccggcccacaaaccgccctctccccacgacctcgtctacttcgagaaatcgcccaacttctgcacgtacagcggacgcctgggcacagcaggcacggcagggcgcgcctgtaacagctcgtcgcccgcgctggacggctgcgagctgctctgctgcggcaggggccaccgcacgcgcacgcagcgcgtcaccgagcgctgcaactgcaccttccactggtgctgccacgtcagctgccgcaactgcacgcacacgcgcgtactgcacgagtgtctgtgaggcgctgcgcggactcgcccccaggaacgctctcct

SEQ ID NO: 215 - DNA, 1866 bp, Canis lupus
atgggcgggggactggcccggggcaaccaaggatcctatctcaccagtgccaccccagggacccttctcatcgctccctccctgagcgaaacactgctctggcgcgaggtcgccaccggagggatgggtcgccggggctcgggcgtctcaaacgtttccccgccgagagctgaatggcaggagaatgcctttgacaagatgaagacggagctgcggggcaactttcctccttggacagtgttgtgcagagccctctgcgagagcgcgccgcagggcacgcagagccagcagcccaaggcacgactggccccgcgcgcccgaggctggcacgttgactcagagacaggccccctggggaagcagagccatggggcgaaacccacagccacagtcatctcttccttggtggtggctatgcagctcttctgggcagtcagcctccagcctgtgctgctgcaggggctgcccttgcggcccggcggggcggcctccccgcgtcacttcagccagcgccgcaactataagaggcggtgccgcccgccgtggctgcctcagcccaccagctgggaccgcgagccatgctgcccgccgcccgcccccggggctggtagagccagactgcggactctcgccaccgccgccaccgccgcgtcccgtcccacgtcgcgggcagccgccaaggccgccccactccagcgcagagcgggcgaggccgggcaggccatggggcactgggcgctgctgcccggcggggtttctgctgcgctcttgctggcgctggccgctctgcccgcagccctggccgccaacagcagcggccgatggtggggcatcgtgaacgtcgcctcctccacgaacctgctgaccgactccaagagtctgcaactggtgctcgagcccagtcttcagctgctgagccgcaaacagcggaggctgatccgtcagaacccggggatcctgcacagcgtgagcggggggctgcagagcgcggtgcgagagtgcaagtggcagttccgcaaccgccgctggaactgccccacggcttcggggccccacctcttcggcaagatcgtcaaccgaggctgtcgggaaaccgcctttatcttcgccatcacctccgccggggttacccattcagtggcacgctcctgctcagagggctccatcgagtcctgcacgtgcgactaccggcggcgcggccccgggggccccgactggcactgggggggctgcagcgacaacatcgacttcggccgcctcttcggcagggagtttgtggactccggggagaaggggcgggacctgcgcttcctcatgaaccttcacaacaacgaggcgggccgcacgacggtgttctccgagatgcgccaggagtgcaagtgccacgggatgtcgggctcgtgcacggtgcgcacgtgctggatgcggctgcccacgctgcgcgcggtgggcgacgtgctgcgcgaccgcttcgatggcgcctcgcgcgtcctctatggcaaccgcggcagcaaccgcgcctcccgggcggagctgctgcgcctggagcccgaagaccccgcgcacaagccgccctccccccacgacctcgtctactttgagaaatcgcccaatttctgcacctacagcggacgcctggggacggcgggcacggcggggcgcgcctgcaacagctcgtcgcccgcgctggacggctgcgagctgctctgctgcggccggggccaccgcacgcgcacacagcgcgtcaccgagcgctgcaactgcaccttccactggtgctgccacgtcagctgccgcaactgcacgcacacgcgcgtactgcacgagtgtctgtgacacgctgcgcggactcgcccccgggagcgt

SEQ ID NO: 216 - DNA, 1186 bp, Bos taurus
caactgcagcatagagcgggcaagggcaggcaggccatggggcactgggcgctgctgccttgctgggtttctgctgcgttgttgctggcgctggccgctctgcctgcagccctggccgccaacagcagtggccgatggtggggcatcgtgaacgtagcctcctccacgaacctgctgaccgattccaagagtctgcagctggtactcgagcccagtctgcagctgctgagccgcaaacagcggcggctgatccgccagaacccggggatcctgcacagcgtgagcggggggctgcagagcgctgtgcgagagtgcaagtggcagttccggaaccgccgctggaactgtcccacggcttcggggccccacctcttcggcaagatcgtcaaccgaggctgtcgggaaacagcatttatcttcgccatcacctcggccggggtcacccactcggtggcgcgctcctgctcagagggctccatcgaatcctgcacgtgcgactatcggcggcgcggtcctgggggccccgattggcactggggaggctgcagcgacaacatcgacttcggccgcctcttcggccgggagtttgtggactcgggagagaaggggcgggaccttcgcttcctcatgaaccttcacaacaatgaggcggggcgcacgaccgtgttctccgagatgcgccaggagtgcaagtgccacgggatgtcgggctcatgcacggtgcgcacgtgctggatgcggctgcccacgctgcgcgcagtgggcgacgtgctgcgggaccgcttcgacggtgcctcgcgcgtcctctacggcaaccgcggcaacaaccgtgcatcgcgggcggaactgctgcgcctggagccggaggacccggctcacaagcctccctcgccccacgacctcgtctacttcgagaagtcgcccaacttctgcacgtacagcggacgcctgggtactgcgggcacggcgggtcgcgcctgcaatagctcgtcgcccgcgctggatggctgcgagctgctctgctgtggccggggccaccgcacgcgcacgcagcgcgtcaccgagcgctgcaactgcaccttccactggtgctgccacgtcagctgccgcaactgcacgcacacgcgcgtactgcacgagtgcctgtgaggcgctgcgcggactcggcccctgggagcactctcct

SEQ ID NO: 217 - DNA, 2371 bp, Mus musculus
gccacagcttcgctcgccactcattgtctgtggccctgaccagtgcgccctggtgcttttagtgccgcccgggcccggaggggcagcctcttctcactgcagtcagcgccgcaactataagaggcctataagaggcggtgcctcccgcagtggctgcttcagcccagcagccaggacagcgaaccatgctgcctgcggcccgcctccagacttattagagccagcctgggaactcgcatcactgccctcaccgctgtgtccagtcccaccgtcgcggacagcaaccacagtcgtcagaaccgcagcacagaaccagcaaggccaggcaggccatggggctctgggcgctgctgcccagctgggtttctactacgttgctactggcactgaccgctctgcccgcagccctggctgccaacagtagtggccgatggtggggcatcgtgaacatagcctcctccacgaacctgttgacggattccaagagtctgcagctggtgctcgagcccagtctgcagctgctgagccgcaagcagcggcgactgatccgacagaacccggggatcctgcacagcgtgagtggagggctccagagcgctgtgcgagagtgcaaatggcaattccgaaaccgccgctggaactgccccactgctccggggccccacctcttcggcaagatcgtcaaccgaggctgccgagaaacagcgttcatcttcgcaatcacctccgccggggtcacacattccgtggcgcgctcctgctccgaaggctccatcgagtcctgcacctgcgactaccggcggcgcggccctgggggccccgactggcactgggggggctgcagtgacaacatcgattttggtcgcctctttggccgagagttcgtggactccggggagaaggggcgggacctacgcttcctcatgaaccttcacaacaacgaggcagggcgaacgaccgtgttctctgagatgcgccaagagtgcaaatgccacgggatgtccggctcctgcacggtgcgcacgtgttggatgcggctgcccacgctgcgcgctgtgggcgacgtgctgcgcgaccgcttcgacggcgcctcccgcgtcctttacggcaaccgaggcagcaaccgcgcctcgcgggcggagctgctgcgcctggagcccgaagaccccgcgcacaagcctccctcccctcacgacctcgtctacttcgagaaatcgcccaacttctgcacgtacagtggccgcctgggcacagctggcacagctggacgagcttgcaacagctcgtctcccgcgctggacggctgtgagctgctgtgctgtggccgaggccaccgcacgcgcacgcagcgcgtcacggagcgctgcaactgcaccttccactggtgctgccacgtcagctgccgcaactgcacgcacacgcgcgttctgcacgagtgtctatgaggtgccgcgcctccgggaacgggaacgctctcttccagttctcagacacactcgctggtcctgatgtttgcccaccctaccgcgtccagccacagtcccagggttcatagcgatccatctctcccacctcctacctggggactcctgaaaccacttgcctgagtcggctcgaacccttttgccatcctgagggccctgacccagcctacctccctccctctttgagggagactccttttgcactgccccccaatttggccagagggtgagagaaagattcttcttctggggtgggggtggggaggtcaactcttgaaggtgttgcggttcctgatgtattttgcgctgtgacctctttgggtattatcacctttccttgtctctcgggtccctataggtcccttgagttctctaaccagcacctctgggcttcaaggcctttcccctcccacctgtagctgaagagtttccgagttgaaagggcacggaaagctaagtgggaaaggaggttgctggacccagcagcaaaaccctacattctccttgtctctgcctcggagccattgaacagctgtgaaccatgcctccctcagcctcctcccaccccttcctgtcctgcctcctcatcactgtgtaaataatttgcaccgaaatgtggccgcagagccacgcgttcggttatgtaaataaaactatttattgtgctgggttccagcctgggttgcagagaccaccctcaccccacctcactgctcctctgttctgctcgccagtccttttgttatccgaccttttttctcttttacccagcttctcataggcgcccttgcccaccggatcagtatttccttccactgtagctattagtggctcctcgcccccaccaatgtagtatcttcctctgaggaataaaatatctattttta

SEQ ID NO: 218 - DNA, 2360 bp, Rattus norvegicus
tttgctcagaccggctagagccacagcttcgctcgctactcattgtctgtggccctgaccagtgcgccctggtgctttagtgcggcccggaggggcagcctcttctcactgcagtcagcgccgcaactataagaggcggtgcctcctgcagcggctgcttcagcccaccagccgggacagcgaaccatgctgcctgcggcccgcctccagactttctagagccagcctgagaatactcaccactgccctcaccgctgtgtccagtcccaccgtcgcggggagcaaccaaagtcgccagaaccgcagcacagaaccagcaaggccaggcaggccatggggctctgggcgctgctgcccagctgggtttctgctacgttgctactggcactgaccgctctgcccgcagccctgggcgccaacagtagtggccgatggtggggcatcgtgaacatagcctcctccacgaacctgctgacagattccaagagtctacagctggtgctagagcccagcctgcagctactgagccgcaagcagcgacgactgatccgacagaacccggggatcctgcacagcgtgagcggagggctgcagagcgccgttcgagagtgcaagtggcaattccgaaaccgccgctggaactgccccactgctcccgggccccacctcttcggcaagatcgtcaaccgaggctgccgagaaacagcgtttatcttcgcaatcacctccgccggggtcacacattctgtggcgcgctcctgctccgaaggctccatcgaatcctgcacctgcgactacaggcggcgcggtcctgggggccccgactggcactgggggggttgcagcgacaacatcgatttcggtcgcctcttcggccgagagttcgtggactctggggagaaggggcgggacctacgcttcctcatgaaccttcacaataacgaggcagggcgcacgaccgtgttctctgagatgcgccaagagtgcaaatgccacgggatgtccggttcctgcaccgtgcgcacgtgttggatgcggctgcccacactgcgcgctgtgggcgacgtgctgcgcgaccgcttcgacggcgcctcccgcgtcctttacggcaaccgaggcaacaaccgcgcttcgcgggcggagctgctgcgcctggagcccgaagaccctgcgcacaagccgccctcccctcacgacctggtctacttcgagaaatcgcccaacttctgcacgtacagtggacgcctgggcacagctggcacagctgggcgagcttgcaacagctcatctccagcgctggacggctgcgagctgctgtgctgtggccgaggccatcgcacgcgcacgcagcgcgtcaccgagcgctgcaactgcaccttccactggtgctgccacgtcagctgccgcaactgcacgcacacgcgcgtactgcacgagtgtctatgaggcgctgcgcctccgggaacgctctcttccagttctcctcagacaaactcgctggctctgatgttcgcccaccctagcgcgtacagccacagtcccgaggttcacagtgacccatctctcccacctcctacctggggactcctaaaaccacttgcctgaggcagctcgaacccttttgccatcctgcgggccctgcccaagcctacctccctccctcttctcgggagaccccttttgcactgcccccccaatttggccagagggtgagagggaaattcttcttgggtgtgggtggtggtggtgggtcagcttgtgaaggcgttgctgtccctgtggtattgtgccccctctccccgtgacctctctgtgtatcaccttccggttttctctccgtgtccctataggtccctaaccaccacacctgggcttcaagcccccctacacacacctgtagctgaagtgtttccgaggtgaaagggcaaggaaagctgtgatgacgtgggaaataaggttggggagcccagcaggaaaaacctacattctcctagtctctgtcaccgagccactgaacagtgaaccatgcctccctcagccacctcccaccccttcctgtcctgctccctcttcatcagtgtgtaaataatttgcaccggaacgcggccacacagagccacgcgttcggttatgtaaataaaactatttattgtgccgggggtttcagcctgggttgcagagcccaccctcatcccaactcactcctcttgtctgccagcctttttgttacccgaccttttctccaaggcaccctgcccaccggatcagcatctcctgccgctgtagctattagtggctcttcgcccccaccgatgtagtatcttcctctgaggaataaaacatctatttttatcaatgac

SEQ ID NO: 219 - DNA, 11564 bp, Homo sapiens
tcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccgggtttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcc

SEQ ID NO: 220 - DNA, 11558 bp, Homo sapiens
tcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccgggtttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagcc

SEQ ID NO: 221 - DNA, 11410 bp, Pan troglodytes
atggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcacattgcgggcaaccccacctactacgttccgggacaagaataccatgtgacaatttcaacaagcaccttctttgatggcttgctggtgacaggactatacacatctacgagtgttcaggcatcacagagcattggaggttccagtgcttttggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattaggtttgttctgaacccatctatttttcactaaatggtactttcagtttaggccatgtaccaaaccaatgcaaatttcccttaccagtggaggttagataatttggagttggccaggaaggaggaatcgtgtacttgcctggacaacatagtaaaaataaaccattgtcattcacagtacgtattactcttgtcttctttagatatttctttctgttttttggcgggggggactctacagcatagctgtcagtcagatgggaactccatttatttccatggaaatgaaggcagtgagttcaattttgccaccacccgggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccattcatggacactaccggttatgggaacctgaggttttattttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcaacctggtaacagtgtcagcttggagttttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccagtgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacatgcagagcccctgaccagcctggtgaaggagttttgttgcattattcttatgataatgggataacttggaaactcctggagcattattcatatctcagctatcatgagcccagaataatctccgtagaactaccaggtgatgcaaggcagtttggaattcagttcagatggtggcaaccgtatcattcttcccagggagaagatgtatgggctgttgatgagattatcatgacgtctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaagaatttacatcagcaagtatttaccatgccagtgagtttacgcagtggagaagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcacggcatatgcaggtgtgaccaggggtaccaaggcactgaatgccacccagaagctgcccttccatccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaaaccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtccaagttactgcagtggccatggggactgcatttcaggagtgtgtttctgtgacctaggatatactgctgcacaaggaacctgtgtgtcaaatgtccccaatcacaatgagatgttcgataggtttgaggggaagctcagccctctgtggtacaagataacaggcgcccaggttggaactggctgtggaacacttaacgatggcaaatctctctacttcaacggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcattccgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcactgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaacttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacattggtctttattgtccgtattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgattttgaaggtcagctagaatcggatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagccaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagactttgctgcctcctgctcagtcacagactcttgttatgcaattgaattggaatactcagtagatcttggattgtcatggcacccattggtaagggactgtctgcctaccaatgtggaatgcagtcgctatcatctgcagcggatcctggtgtcagacactttcaacaagtggaccagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattgttagtcactgtggatctaaacctcactaatgctgagttcatccaattttacttcatgtatgggtgcctgattacaccaaacaaccgtaaccaaggtgttctcttggaatattctgtcaatggaggcattacctggaacctgcttatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcacgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcgattacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttctaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcgactcgtacagacccagtgccttccttcctcttctaagagcattggctgctcccctttccatttccatgaagccaccatcaaagggtctgtcagctcctcctgctggaaaacaaacaccatcctcctgcctgaccaagtctccactaatgcgacacagttccgctggatccagaagggagaagaaactgagaagcaaagctgggcaattgaccacgtgtacattggagaggcttgccccaagctctgcagcgggcacggatactgcacaaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgctcatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttactcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcagctatgtctcatgttttatatgattaaattatcattgtttgtcctttatgtattctcttctacaatataacacattgaaactgtatttacttgttatgttgtaatattttgctgctgaatttggggctacttatattctgcagaaaattaattgaaatacctattcaagaagatagttgtaaagatattgtatctatctcctttaatatacttcttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttctttgtggattgttttttctgcgggtcatattcataccttctgatgaagttgtacaacaccagcaacattataatggccctgtagctctgaatgctatttgtgtaactgaaaggttgcactctagggtgaaccaagctaaaagcccatgcttaaataaaaattatgtccaaaagccattgaa

SEQ ID NO: 222 - DNA, 11433 bp, Canis lupus
atggagcgcagctgggccccgcggacgtggctcgtggcgctgctgctcggggcgacgctgggggcgcgcgcggcgggcccctcgccgggctcctcgccgggctcctcgccgggcccctggccgcgctcctcgccgcgcttctcgcccttcttcttcctgtgcacgcaccacggggagctggccggggacggcgagcagggcgaggtgctcatctccctgcacctcgcgggcaaccccacctactacgtgccggggcaggagtaccacgtgacaatttcaacgagtaccttctttgatggcttgctggtgacaggactatacacatctacaagcgttcaggcttcacagagcattggaggttccaatgcgtttggatttgggatcatgtctgaccaccagtttggtaaccagtttatgtgcagtgtggtggcctctcatgtgagtcatctacccacaaccaacctcagcttcgtctggattgctccacctgcaggcaccggctgcgtgaatttcatggctacggcgacacacaggggccagattattttcaaagatgcgttagcccagcagttgtgtgaacaaggagctccaacagaagccacgatgcacccacatctagctgaagtacatagcgaaagcattatcctacgagatgactttgactcctaccaccaactagagttgaatccaaatatatgggttgaatgtaagaactgtgagaccggagaacagtgtggtgcaattatgcatggcaatgctgtcaccttctgtgagccatatggtccgagagaattgattaccacaagccttaatacaacaactgcctctgtcctccaattttccattggctcgggttcgtgtcgctttagttattcggaccccagcatcaccatgtcctatgccaagaataataccgcagactggattcagcttgagagaattagagccccttccaatgtcagcacaaccatccatatcctctaccttcctgaagacgccaaaggggagaacgtccagtttcagtggaagcaagaaagtctccatgtaggcgaagtgtatgaagcctgctgggccttagataacatcctgatcatcaactcagctcacaaacaagtcattttagaagacactcttgatccagtagacacaggcaactggctttttttcccaggagctacagttaagcatagctgtcagtcagaaggcaactctatttatttccacggaaatgaaggaagtgagttcaattttgccaccacccgggatgtagatctttctacagaggatattcaagagcagtggtcagaagaatttgaaagccagcctacagggtgggacatcttgggagctgtaattggtacagaatgtggaacagtagaatcaggtttatcagcagtcttcctcaaagatggagagaggaaattatgcaccccttatatggataccaccggttatgggaacttgagattttactttgtcatgggaggaatgtgtgaccctggagattctcatgaaaatgatatctccctgtatgcaaagattgaaggaagaaaagagcacattacactggatacactttcctattcctcatataaggttccatctttagtttccgtcgtcatcaatcctgaacttcagactcctgctaccagattttgtctcaggcaaaaaaaccaccaagggcataacaggaatgtctgggctgtcgattttttccacgtcttacctgttctcccttctacgatgtctcacatgatacagttttccattaatctgggatgtggaacacatcaacctggtaacagcatcagcttagagttttccaccaaccatgggcgttcctggtcgctcctgcacactgagtgtttacctgagatctgtgctggaccccacctcccccacagcactatctactcctccgaaaactatagcgggtggaaccgaataacgattccccttcctaatgcagcactaaccagggacaccagaattcgctggagacaaacgggaccaatccttggaaacatgtgggcaattgataatgtttatattggtccgtcgtgtctcaagttctgttccggcagaggacagtgcactcgacatggttgcaagtgtgaccctggattttctggcccagcctgtgagatggcatcccagacattcccaatgtttatttctgaaagctttggcagttccaggctctcctcctaccataacttttactctatccgtggtgctgaagtcagctttggttgtggtgtcttggccagtggtaaggccctggttttcaacaaggatgggaggcgtcagctaattacatctttccttgacagctcacagtccaggtttctgcagttcacattgaggctggggagcaagtctgttctgagcacatgcagagcccctgaccagcctggtgaaggagttttattgcattattcttatgataatgggataacttggaaactcttggagcactattcatatctcaactatcatgagcccagaatcatctctgtagagttaccagatgatgcaagacagtttggaattcagttcagatggtggcaaccatatcattcttcccagggagaagatgtatgggccattgatgagattatcatgacatctgtccttttcaacagcattagccttgactttaccaatcttgtggaggtcactcaatctctaggattctaccttggaaatgttcagccatactgtagccatgactggacactttgtttcacaggagattctaaacttgcctcaagtatgcgctatgtggaaacacaatcaatgcagataggagcatcctatatgattcagttcagtttggtgatgggctgtggccagaaatacactccgcacatggacaaccaggtgaaactggagtactccaccaaccacggcctcacctggcacctggtccaagaggaatgtcttccaagtatgccaagttgtcaagaattcacatcggcaagtatttaccacgccagtgagttcatgcagtggcgaagagtcatagtgcttcttccccagaaaacttggtccagtgccacccgcttccgctggagtcaaagctactacacagcccaggacgagtgggctttggacaacatttacattgggcagcagtgtccaaacatgtgcagcgggcacggctcctgtgaccacggcgtgtgcaggtgcgaccagggataccaaggcaccgagtgccacccagaagctgctcttccttccacgattatgtcagactttgagaaccagaatggttgggagtctgactggcaagaagtcatcgggggagaaattgtaaaaccagaacaagggtgtggggtcatctcatctggatcatctctgtatttcagcaaggcggggaaaagacagctggtgagctgggatctggacacttcttgggtggactttgtccagttctacattcagattggtggagagagtgctgcgtgtaacaagccagacagcagagaggagggtgtcctccttcagtacagcaacaatggaggcatccagtggcacctgctggcagaaatgtacttctcagacttcagcaaacccagattcgtctacctggagctcccagctgctgctaagaccccttgtaccaggttccgctggtggcagcctgtgttctcaggggagggctacgaccagtgggcattggatgacatcatcatcctgtcagagaagcaaaagcaggtcatcccaattgtgaacccaactttaccccagaacttttatgagaagccagcttttgattacccaatgaatcaaatgagtgtttggttgatgttggctaatgaaggaatggttaaaaatgagactttctgctctgccacgccatcagccatggtatttggaaaatcagacggggatcgatttgcagtaactcgagatttgactttgaaacctggatacgtactacagttcaagctaaacatagggtgtgccaatcagttcagcagtgctgccccagttcttcttcagtactctcacgatgctggtatgtcctggtttctggtgaaagaaggctgttacccagcttctgcaggcaaaggatgtgaaggaaactccagggaactaagtgagcccaccatgtatcacacgggggactttgaagaatggacaagaatcaccatcattatcccaaggtctcttgcgtccagtaaaaccagattccggtggattcaggagagcagctcacagaagaatgtgcctccctttggtctggatggagtgtacatatctgagccttgtcccagttactgcagtggccacggggactgtgtctcaggggtgtgtttctgtgacctgggatatactgctgcacaagggacctgtgtgtctaatgtccctaatcacagtgagatgttcgataggtttgaggggaagctcagccctctatggtacaagataactggaggccaggttggaaccggctgcggaacacttaatgatggcaaatctctctacttcaatggccctggcaaaagggaagcgaggactgtccccctggacaccaggaatatccgacttgttcagttttatatacagattggaagtaaaacttcaggaattacctgcatcaaaccaagagctagaaatgaagggcttgttgttcagtattcaaatgacaacgggatactctggcatttgcttcgagagttggacttcatgtcatttctggagccacagatcatttccattgacctaccacgggaggcgaaaacccccgctacagcttttcgatggtggcagccccaacatgggaaacattcagcccagtgggccttggatgatgtccttataggaatgaatgacagctctcaaactgggtttcaagacaaatttgatggctccattgatttgcaagccagctggtaccggatccagggaggtcaagttggtattgactgtctctctatggacaccgctctcatattcactgaaaacataggaaaacctcgttatgcagagacctgggattttcatgtgtcagcatcaaccttcttgcagtttgaaatgagcatgggctgcagcaagcccttcagcaactcccacagtgtacagctccagtattctctaaacaacggcagggactggcacctggtcactgaagagtgtgtgcctccaaccattggctgcctgcactacacggaaagttcaacttacacctccgaacgattccagaattggaagcggatcaccgtctaccttccactctccaccatatctcccaggacccgcttccgatggattcagtccaactacaccatgggggccgactcctgggctattgataacgttctgctggcctcggggtgcccctggctgtgctcaggacgagggatttgcgatgacggacgctgtgtgtgtgaccggggctttggtggagcctactgtgtgccagttgttcctctgccctccattcttaaggatgatttcaatgggaacctacatcccgatctttggcctgaagtgtatggtgctgagagggggaatctgaatggtgaaaccatcaaatctggaacatcgcttatttttaaaggggaaggactgaggatgcttatttcaagagatctagactgtaccaatactatgtatgtccagttttcacttagatttatagcaaaaggtaccccagagaggtctcactctattctattacaattctccatcaatgggggaatcacttggcacctgatggatgaattttacttccctcaaacaaccaacatacttttcattaatgttcccttgccatatactgcccagaccaacgctacaaggttcagactctggcaaccttataataacggtaagaaagaagaaatctggattattgatgacttcattattgatgggaataatctaaacaaccctctgatgctactggatacatttgactttggacccagagaagacaattggtttttctatcctggtggtaacattggtctttattgcccatattcttcaaaaggagcacccgaggaagattcagctatggtatttgtttcaaatgaagttggtgagcattccattaccactcgtgacctggatgtgaatgagaacaccatcatacaatttgagatcaatgttggatgctccactgatagctcatctactgatccggtcagacttgagttttcaagggacttcggggccacttggcacctgctgctccccctctgctaccacagcagcagccacatcagctccctgtgctccactgagcaccacccaagcagcgcctactacccagggaccacccagggctggagaagggaagtcgtgcactttgggaagttgcacctttgcggatctgtgcgtttcagatggtaccaaggattttaccctgctggctctcagccagtgacatgggccattgataatgtctatatcggtccccaatgtgaagagatgtgtaacggacatgggagttgtatcaatggaaccaagtgtatatgtgaccctggctactcaggcccaacctgtaaaataagcaccaaaaatcctgactttctcaaggatgattttgaaggtcagctagaatccgatagattcttattaatgagtggtggaaagccatctcggaagtgtggaatcctttccagtggaaacaacctctttttcaatgaagatggcttacgcatgttgatgacacgcgatctagatttatcacatgctagatttgtgcagttcttcatgagactaggatgtggtaagggtgttcctgaccccaggagccagcctgtgcttctacagtattcactcaatggcggcctctcatggagtctccttcaagagttccttttcagcaactcgagcaacgtgggcaggtacattgccctggagatacccttgaaagcgcgttcggcttctactcgcctccgctggtggcaaccatctgaaaatgggcacttctacagtccctgggtaatcgaccagattcttattggaggaaacatttctggcaatacagtcttggaggatgatttcacaaccctggacagtaggaaatggctacttcacccaggaggcaccaagatgcctgtgtgtggctctactggtgatgccctggtcttcattgaaaaggccagtacccgctatgtggtcaccacagacattgctgtgaatgaggattcatttctacagatagattttgctgcctcctgctcggtcaccgactcctgttatgctattgaattggaatactcagtagatcttggattatcatggcacccattggtaagggactgtctacctaccaatgttgaatgcagtcgatatcacctgcagcggatcctggtgtcagacaccttcaacaaatggacgagaatcaccctgcctctccctcattataccaggtcccaagcaactcgtttccgttggcatcaaccagctccttttgacaagcagcagacgtgggcgatagataacgtctacatcggggacggctgtatagatatgtgcagtggccatggacggtgcatccaaggaagctgtgtctgtgatgagcagtggggtggcctctactgtgatgagcccgagatctcccttccaacccaactcaaagacaacttcaatagagcgccatccaaccagaactggttgaccgtgaatggagggaaactcagtaccgtgtgtggcgctgtggcttcaggaatggctctgcatttcagcgggggctgcagccgactgttggtcacggtggatctgaacctcactaatgctgagtttatccaattttacttcatgtacggatgcctgattacacccaacaaccgcaaccaaggtgttctcctggaatattctgtcaacggaggcattacctggaacctgctaatggaaattttctatgatcagtacagtaaacctggattcgtaaatatccttctccctcctgatgcaaaagagattgctactcgcttccgctggtggcagccaaggcatgacggcctggatcagaacgattgggccatcgacaatgtcctcatctcgggctctgccgaccagaggaccgtcatgctggacaccttcagcagcgcccctgtgccccagcatgagcgctcccccgcagacgctgggcctgtcgggagaattgcctttgacatgtttatggaggataagacgtcagtgaatgagcattggctattccatgatgattgcacagtagaaagattctgtgactcccctgatggtgtcatgatttgtggtagccatgatggaagagaagtatatgcagtgacccatgacctgactcccactgaaggctggatcatgcaattcaagatctctgttggatgtaaagtatctgaaaaagttgcccagaatcaaattcatgtgcagtattctactgactttggtgtgagctggaattatctggtcccccagtgcttacctgcagacccaaaatgttctggaagtgtttctcagccatctgtattctttccaaccaaagggtggaaaaggatcacctacccactccctgaaagcttagtggggaatccagtaagattaaggttctatcagaagtactcagatgtgcagtgggcaatcgataatttctacctgggccctggatgcgtggacaactgtaggggccatggagattgcttaaaggaacagtgcatctgtgatccgggatactctgggcctaactgctacttgactcacactctgaagactttcctgaaggaacgctttgatagtgaagaaatcaagcctgatttatggatgtccttagaaggtggaagtacttgtactgagtgtgggattcttgctgaggacactgcactctattttgggggatccactgtgagacaagctattactcaagatttggatctcagaggggcaaaattcctacaatactgggggcgcatcgggagtgaaaacaatatgacctcctgccatcggcccatctgccggaaggaaggcgtgctgttggactactctaccgatggaggaattacatggactttgcttcatgagatggactaccagaaatatatttctgttagacatgactacatacttcttcctgaggacgccctcaccaacacaactcgacttcgctggtggcagccttttgtgatcagcaatggacttgtggtctctggggtagagcgtgcccagtgggctctagacaacatactgattggaggagcagaaatcaatcctagtcaactggtcgatacttttgatgatgaaggtacttcccatgaagaaaattggagtttttaccctaatgcagtgaggacagcaggattctgtggcaatccatccttccacctatactggccgaataaaaagaaggacaagacccacaatgctctctcctccagagaactcattatacagccaggatatatgatgcagtttaaaattgttgtgggttgcgaagccacttcttgtggtgaccttcactctgtaatgttggagtacactaaggatgcaaggtctgattcctggcagctcgttcagacccagtgccttccttcctcttcaaacagcattggctgctcccccttccagttccatgaagccaccatctacaatgctgtcaacagctcaagctggaagagaatcaccattcagctgcctgaccatgtctcctccagtgcaacacagttccgctggatccagaagggagaagaaactgagaagcagagctgggcgattgaccatgtgtacatcggagaggcttgccccaagctctgcagtggacacggatactgcaccactggcgccgtctgcatctgtgatgagagtttccaaggtgatgattgctctgttttcagtcatgatcttcccagttatattaaagataattttgagtcagcaagagtcacagaagcaaactgggagaccattcaaggcggggtaataggaagtggctgtgggcagctggcaccctatgcccatggagactccctctattttaatggctgtcagataaggcaggcggccaccaagcctctggatctcactcgagcaagcaaaatcatgtttgttttgcaaattggaagcacgtcacagacggacagttgcaacagtgacatgagtggcccgcacgctgtagacaaggcagtgctgctgcagtacagcgtcaacaacgggatcacctggcacgtcatcgcgcagcaccagcccaaggacttcacgcaggctcagagggtgtcttacaacgtccccctggaggcacggatgaaaggagttttattgcgctggtggcaaccacgccacaatggaacaggtcatgatcaatgggctttggaccatgtggaggtcgtcctagtaagcactcgcaaacaaaattacatgatgaatttttcacgacaacatgggctcaggcacttctacaacagaagacgaaggtcacttagacgatacccctgaagaatcaaaaattttatttttccttccaacatgtgatgtgttgcttcccgttcttttaaatcgcgcactgcatctggtatcaggaaaattctatgaaggacttggtgactaactggaagcccttctcaagaccgagtgtataccactttcccacactgtgaactaatgacaagtgacttattttctcataagtaaatgtcttcatgttgctgtgtccgtgaaaattgtgatctgttgtaatatcagttacagtggcagtatggaaaataagaaatagtttaacagaaaaaaaagtttaagcacaaaaatttaagagattttatgtttaaaatggcatttagtacagaatttcaccttcttggtcacaaagctatttaagtggactgtatttcagctctgtatcatgttttatatgattaaattatcattgtttgttcttttatgtattctcttctacagtataatacattgacactgtatttacttgttttgttgcaatattttgctgctgaatttcgggctacttctattctgcagaaaattcatcgagatacctactcaagaagatagttgtaaagatattgtatctcctttaatatactccttaaaatgtatgttggtttagcgttgttttgtggataagaaaaatgcttgaccttgaaatattttctacttaaaaattgtggatgaaaaccctatctcccacaaagttcccatctccttgtctaagggttttttaaagtgttctgtggctgatttactaacagtaactgccatttcgtgtctgtggtaacagagtgatttgtaaaacagtggatgttctcattgtgttctcttcgtggactgtttttcctgtgggtcatactcattccttctgaagaagttgtgctaacaccagcaacagtataatggccctgtagccctgaactcttctttaacctaactgaaaggttgtactctagggtgaaccaagctaaaagcccatgcttaaataaaaattatgtccat

SEQ ID NO: 223 - DNA, 977 bp, Bos taurus
ggtttccttccttcatcatactgtgccgatccttctgggtcctctgggccctcagagggcactgcaggcatactctacccttctgctcgccatctttcttttagttattaatgcagcaaagggctacagcaacacacaggggccagattatcttcaaagatgctttagcccagcaattgtgtgaacaaggagctccaacagaggccactgtgcacccacatctagctgaaattcatagtgacagtattatcctacgagatgattttgactcctaccaccaaaaggaattgaatccaaacatatgggtggaatgtaacaactgtgagactggagaacagtgtggtgcaattatgcatggcaatgctgtcaccttctgtgagccatatggtccaagagagttgattaccacaggccttaatacaacaacagcttctgtcctccagttttccattggttcaggttcatgtcgctatagttactcagacccttgtatcatcgtgtcatatgccaagaataatactgcggactggattcagcttgagaaaattagagccccttccaatgtcagtactattatccacatcctctaccttcctgaagacgccaaaggggagaacgtccagtttcagtggaagcaggaaaatctacaagtaggtgaagtgtatgaagcctgctgggccttagataacatcctcatcatcaactcagctcacagacaagttgttttagaagacaatctggatccagtagacacgggcaactggcttttcttcccaggagctacagtgaaggtttgatctctctttcactccttctcttctcctctaaaacctaaagctcaataaaccaaattgtactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaa

SEQ ID NO: 224 - DNA, 11702 bp, Mus musculus
cccaagcccggccgaggggcgtcgcgtgcacaccggcggcggcggcgctcggaggcggacgacgcgctctcggcgcccgcggccccggttccccccgcgctctcgctccggcggcccaaagtaacttcgggagcctcggtctcccgctaacttccccccgcgggctcggttgcccggacccgctcggctcgagcccgccgccggctcgccttccccgcacgcggctcctccgtgccggtgcctccgaaagtggatgagagagcgcgcggggcgcgcggcggcacggagcgcggcggcatggagcgcggctgctgggcgccgcgggctctcgtcctggccgtgctgctgctgctggcgacgctgagggcgcgcgcggccaccggctactacccgcgcttctcgcctttctttttcctgtgcacccaccacggggagctggaaggggatggggagcagggcgaggtgctcatttccctgcacattgcgggcaaccccacctactacgtaccgggacaggaataccatgttacaatttcaacaagcaccttctttgatggcttgctggtgacgggactctatacctcgacaagcatccagtcttctcagagcattggaggctccagcgcctttggattcgggatcatgtccgaccaccagtttggtaaccagtttatgtgcagtgtggtggcctctcatgtgagtcacctgcctacaaccaacctcagctttgtctggattgccccaccagctggcacaggctgtgtgaatttcatggctactgcaacacataggggccaggtgattttcaaagacgcactggcccagcagctgtgtgaacaaggagctcccacagaggccactgcttactcgcaccttgctgaaatacacagtgacagtgtgatcctacgagatgactttgactcctaccagcaactggaattgaaccccaacatatgggttgaatgcagcaactgtgagatgggagagcagtgtggcaccatcatgcatggcaatgctgtcaccttctgtgagccgtacggccctcgagagctgaccaccacatgcctgaacacaacaacagcatctgtcctccagttttccattgggtcaggatcatgtcgatttagttactctgaccccagcatcactgtgtcatacgccaagaacaataccgctgattggattcagctggagaaaattagagccccttccaatgtgagcacagtcatccacatcctgtacctccccgaggaagccaaaggggagagcgtgcagttccagtggaaacaggacagcctgcgagtgggtgaggtgtatgaggcctgctgggccctggataacatcctggtcatcaattcagcccacagagaagtcgttctggaggacaacctcgacccggtcgacacgggcaactggctcttcttccctggagcaacggtcaagcatagctgtcagtcagatgggaactccatttatttccatggaaatgaaggcagcgagttcaattttgccaccacccgggatgtagatctttctacagaggatattcaagagcagtggtcagaagaatttgagagccagcccacaggatgggatatcttgggagcagtagttggtgcagactgtggaaccgtagaatcaggactatcactggtgttcctcaaagatggagagaggaagctttgcaccccctacatggatacaactggttatggcaacctgaggttctacttcgttatgggaggaatctgtgaccctggagtctctcatgaaaacgatatcatcttatatgcaaagattgaaggaagaaaagaacacattgcactggacactcttacctattcttcctataaggttccgtctttggtttctgtggtcatcaaccctgaacttcagacacctgccaccaaattttgtctcaggcaaaagagccaccaagggtataatcggaatgtctgggctgtggacttcttccatgtgctgcccgttctcccttcaacaatgtctcacatgatccagttttctattaatttgggatgcggcacacaccagcctgggaacagcgtcagcttggagttttctactaaccatggacggtcctggtccctactccacactgagtgcttgccggagatctgtgcaggcccccacctcccccacagcactgtctactcctcagaaaactacagcgggtggaaccgaatcacgattcctctccctaatgcagcactcacccgagacaccaggattcgctggagacaaacaggcccaatcctgggaaatatgtgggcaattgataatgtttatataggtccttcgtgtctcaaattctgttctggcagaggacaatgcactcggcatggctgcaagtgtgacccaggattttctggcccagcttgtgagatggcatctcagacattcccaatgtttatttcggaaagctttggcagtgccagactttcctcttaccataacttttactctatccgtggtgctgaagtcagctttggttgtggtgtcttagccagtggtaaggctctggttttcaacaaagatgggaggcggcagctaatcacgtcctttctggacagctcgcagtccaggtttcttcagtttacactgaggctggggagcaagtctgtgctgagcacgtgcagagcccctgaccagccgggggagggagtcctgctgcactattcatatgacaacgggataacatggaaactcctggagcactattcctacgtcaactaccacgagcccagaataatctctgtagagctaccggatgatgcaagacagtttggaatccagttcagatggtggcagccttaccattcttcccaaggagaagacgtgtgggccattgatgagattgtcatgacctcagtcctgttcaacagcatcagtctcgactttaccaatcttgtggaagtcactcaatccctgggattctaccttggcaatgttcaaccatactgtggccatgactggacgctttgttttacgggagattctaaacttgcctcaagcatgcgctatgtggaaacacagtccatgcagatcggagcatcctatatgattcagttcagcctagtgatgggatgtggccagaaatacactcctcacatggacaaccaggtgaagctggagtactcagccaaccacggccttacatggcaccttgtacaagaagaatgccttcccagtatgccaagctgccaggaatttacatctgccagcatttaccatgccagcgagttcacacagtggagaagagtcactgttgttcttccccagaaaacatggtccggtgccacccgcttccgttggagtcagagctattacacagcccaggatgagtgggctttagacaacatttacattgggcagcagtgccccaacatgtgcagtgggcatggctcatgtgaccatggcgtgtgcaggtgtgaccagggataccagggcactgaatgccacccagaagctgcacttccttccacgattatgtcagattttgagaacccgagcagttgggaatcagactggcaggaagttattgggggagaagttgtaaagcctgagcaaggctgtggagtcgtgtcttctggatcttctctgtacttcagcaaggctgggaagaggcagctggtgagctgggacctggacacatcctgggtggactttgtccagttctacatccagataggaggagagagtgctgcatgcaacaagcctgacagcagagaggagggcattctgctccagtatagcaacaacgggggcatccagtggcacctgctggcagagatgtacttctcagacttcagcaaacccagatttgtctacctggagctcccagctgctgcgaagaccccttgtaccaggttccgctggtggcagcctgtgttctcgggggaggactatgaccagtgggccgttgatgatatcatcattctgtcagagaagcagaagcaggttattccagttgtcaacccaactttgccccagaacttctatgagaagccagctttcgattaccctatgaaccaaatgagtgtgtggctaatgttggccaatgaaggcatggctaaaaacgacagcttctgtgcgaccacgccgtcagccatggtgtttggaaagtcagatggagaccggtttgcagtaactcgagatctgaccctgaaacctggatatgtgctgcagttcaagctaaacataggctgcaccagccagttcagcagcactgccccggttctcctgcagtattcacatgatgccggcatgtcgtggtttctggtgaaggaaggatgcttcccagcgtcagcaggcaaaggatgtgaagggaactccagggaattgagtgagcctactgtctattatactggggacttcgaagaatggactagaatcaccattgccattccaaggtcccttgcatccagcaagaccagattccgatggatccaagagagcagctctcagaagaatgtgcccccgtttggcttagatggggtgtacatatctgagccttgtcccagttactgcagtggccatggagactgcatctcgggggtgtgtttttgtgacctggggtacacagctgcacaaggaacctgtgtgtcaaacacccctaaccacagtgagatgttcgacaggtttgaggggaagctaagcccactgtggtacaaaatcaccgggggtcaggttggcacgggctgtggcaccctcaatgacggcaggtccctctactttaatggccttgggaaaagggaagccaggacagtcccactggacaccaggaatatcagacttgttcagttttatatacaaattggaagtaaaacatcagggattacgtgcatcaaaccacgggctagaaatgaggggcttgttgttcagtattccaatgataatgggatactttggcatttgctgagagagttggatttcatgtcattcctggagccacagatcatttccattgacctgccccgggaagcaaagacacctgccacagctttccggtggtggcagccgcagcatgggaagcattcggcccagtgggctttggatgatgtccttataggagtgaatgacagctctcaaactggatttcaagataaatttgatggctccatagacttgcaagccaactggtatcgaatccagggaggccaagttgatatcgactgcctctctatggacactgcccttatattcactgaaaacataggaaaacctcgctatgctgagacctgggacttccatgtgtcagcgtcaagcttcttacagtttgaaatgaacatgggctgcagcaagcctttcagtggtgcccacggcatacagctccagtactctctgaacaacggcaaggactggcagcttgtcaccgaagagtgtgtccctccaaccattggctgcgtgcactacacagagagttcaacttacacatcagaaagattccagaactggaggcgggtcacggtctacctgccactcgccaccaattctcccaggactcggttcagatggattcagaccaactatactgttggagcagattcctgggctattgataatgtcatcctggcctcgggctgtccttggatgtgctcaggacgagggatctgtgattcggggcgctgtgtgtgtgaccggggcttcggtggacccttctgtgttcctgttgttcctcttccctccattctaaaagatgatttcaatgggaacttacatcctgacctttggcctgaagtgtacggggcagagaggggcaatctgaatggcgaaaccatcaaatccggaacatgtctgatctttaaaggggagggactaagaatgcttatttccagagatctagattgcaccaatactatgtatgtccagttctctctccgatttatagcgaaaggtaccccagagaggtctcactccatccttctacagttctctgtcagtggaggagtcacctggcacctgatggatgaattctacttccctcaaacgaccagcatacttttcatcaatgttcccttaccatacggtgcccaaaccaacgctacaagattcagactctggcaaccgtacaataatggtaagaaagaagaaatctggatcattgatgactttattattgatggaaacaatttgaacaaccccgtgctgctgctggacacgttcgactttgggcccagggaagacaattggtttttctatccgggtggtaatatcggactttactgcccgtattcttcaaagggagctcctgaggaggattcggccatggtgtttgtttcaaacgaagttggagaacactccattaccacacgagacctaagtgtgaacgagaacaccatcattcaatttgagatcaatgttggctgctccactgatagttcttctgctgatccggtcagactggaattctcaagggactttggagccacctggcacctgctgctgcctctctgctaccacagcagcagcctcgtcagctccttatgctccactgagcatcacccgagcagcacctactacgcggggaccacccagggctggcggcgggaggtcgtgcacttcggaaagctgcacctttgtggatctgtgcgtttccgttggtaccagggattttatcctgctggctctcagccggtcacatgggccattgacaatgtctacattggtccccagtgtgaagagatgtgctatgggcacgggagctgcatcaatggaaccaagtgtatatgtgacccgggctactctgggccaacctgtaaaataagcaccaaaaatcctgattttctcaaagacgactttgaaggtcaactggaatccgatcgattcttactgatgagcggtgggaagccgtctcgtaagtgtggcatcctttccagtgggaacaacctcttcttcaatgaggacggcttgcgcatgctagtaacacgggacctggatttatcacatgcaaggtttgtgcagttcttcatgagactgggatgtggtaaaggtgttccagaccccaggagccagcccgtgcttctgcagtactccctcaatggcggcctctcctggagtcttcttcaagagttcctcttcagcaactccagcaatgtgggcaggtacattgccctggaaatgcccctgaaagcccgttctggttcgacacgcctccgctggtggcagccatctgaaaatgggcacttctatagcccctgggtgatcgaccagattcttattggaggaaatatctctggtaatacagtcttagaagatgatttctcaactctggacagcagaaagtggctgcttcacccaggaggcaccaagatgcctgtgtgtggctccacaggcgatgccctggtctttattgaaaaggccagcacccgttacgtggtcacgacagacatcgctgtgaatgaggactcattcctacagatagactttgctgcctcctgctcagtcacagactcctgctatgctattgaactggagtactcggtggatctcggtctgtcgtggcacccgctggtgagggactgcctgcctaccaatgttgagtgtagtcgttaccacctgcagcggatcctggtgtcagatactttcaacaagtggaccagaatcactctgcccctgccttcctacaccaggtctcaagccactcgtttccgctggcatcagccagcgccttttgacaagcagcagacctgggcaatagataatgtctatattggggatggttgcctagacatgtgcagtggccacgggagatgcgtccagggaagctgtgtctgtgatgaacagtggggaggcctgtactgtgatgagcctgagacctcccttcccacccagctcaaagacaacttcaaccgagccccctccaaccagaactggctgactgtgagcggtgggaagctgagtacagtgtgtggggctgtggcttccggcctggctctccatttcagtgggggctgcagccgattgttagtcactgtggatctgaacctcaccaatgctgagtttatccagttttactttatgtatggatgcctcattacgccgagcaaccgtaaccagggagtcctgctggagtactctgtcaatggaggcatcacctggaacttgctgatggagattttctatgaccagtacagcaaacctggatttgtgaatatccttctccctcctgatgctaaagagattgccactcgcttccgatggtggcagccacgacatgatggccttgaccagaatgactgggccattgacaatgtcctcatctcgggctctgcggaccagaggacagtcatgctggacacctttagcagcgccccagtaccacagcatgagcgctcccccgcagacgctggccctgttggaagaattgcttttgaaatgttcttagaagacaaaacttcagtgaatgagaattggctcttccatgatgactgtacagtggaaagattctgtgactcgccagatggtgtcatgctctgtggcagccatgatggacgagaggtgtatgcagtgactcatgacctgacgcccactgagaactggatcatgcagttcaagatctctgttggatgcaaagtgcctgaaaaaattgcccagaatcaaattcacgtgcagttttctactgactttggcgtgagctggagttatttagtccctcagtgcttacccgccgacccaaagtgttctggaagcgtttctcaaccgtctgtgttcttcccaactgaagggtggaaaaggatcacctacccgcttcctgaaagcttaacggggaatcctgtaagatttaggttctaccaaaagtactcagatgtgcagtgggcaattgacaatttctaccttggccctggatgtttggacaactgtggaggccacggagactgcctaaaggaacagtgtatctgtgacccaggctactcagggccaaactgctacttaactcacagcctgaagactttcctgaaggagcgctttgacagtgaggagatcaagcctgacttatggatgtccttggaaggcggaagcacttgtacagagtgcggggtcctcgccgagaacactgcactctattttgggggatccactgtgagacaagctattactcaagacttagatctcagaggtgcaaaattcctgcagtactggggacgtatcggcagtgagaacaacatgacatcttgccatcggcctgtctgccggaaggaaggcgtgctgctggacttctctacggatggaggaatcacttggaccttgcttcacgagatggatttccagaaatacatttctgtgaggcacgactacatcctcctgcctgagggggccctcaccaacacaactcgacttcgctggtggcagccttttgtcatcagcaatgggctcgtggtttccggggtggagcgtgcgcagtgggcactggacaacattctgattggtggagcagaaatcaatccaagccaactggtggacactttcgatgacgaaggctcctcccatgaagaaaactggagtttttaccctaatgcagtaaggacagcaggattctgtggcaacccatccttccacctctactggccaaataaaaagaaggacaagacccacaatgcactctcctcccgagagctcattatacagccaggatacatgatgcaatttaaaattgtggtgggttgtgaagccacttcatgtggtgaccttcattccgtgatgctggagtacaccaaggatgcaaggtccgattcctggcagctcgtgcagacccagtgcctaccttcctcttccaatagcattggctgctccccgttccagttccatgaagccaccatttataatgctgtcaacagctcaagctggaagaggatcaccatccagctcccagaccacgtctcgtcaagtgccacacagttccgctggatccagaagggagaagaaaccgagaagcaaagctgggccatcgaccacgtgtacatcggagaggcttgtcccaagctctgcagcgggcatggctactgcaccacaggggccgtctgcatctgcgatgaaagcttccaaggtgacgactgctctgtcttcagtcacgagcttcctagttacattaaagataattttgaatcagcaagagtcactgaagccaactgggaaaccatccagggtggagtgatcggaagtggctgtgggcagctggcgccctatgcccatggagattcgctctactttaatggttgtcagataaggcaagctgccaccaagccactggacctcactcgagcaagcaaaattatgtttgtcttgcaaattgggagcccagcccagacagacagttgcaacagcgacctcagcggcccccacaccgtggacaaagcagtactgctgcagtacagtgtcaacaatggcatcacctggcacgtcatcgctcagcaccagccgaaggacttcacacaagctcagcgggtgtcttacaacgtccccctggaagctcggatgaaaggagttctactgcgctggtggcagccacgccacaatggaacaggtcatgatcaatgggctttggaccatgtggaggtcgtcctagtaagcactcgcaaacaaaattacatgatgaatttttcacggcaacatgggctcaggcacttctacaacagaagacgaaggtcgcttaggcgatacccatgaagaatccaagtttatttccctttccagcgtacaatgtgtcccttcctggttttttgaaacacctctcactgcatctgatatcaggaaacaaagatgaaggacttggcgaacagaaagcccttcgagatcttgtgtaccccaccttcccacactgtgagctaatgatgtgtggtttctctgcacataagtaaatgtcttcacgtcagtgcgtccgtggaaattgtgatctgttgtaatatcagttacagtggcagtattgagaataagaaatagtttaacaggaaaaaacgtttaagcacaaacatttttaagatcttatgttttaagtggcattttagcacagtatttaacattgttggtcaccgagctatttaagtagactgtatttcagctctgtctcttgtttatatgaataagttctcgtcgtttgtcctttatgtattcttctctaccgtataacacactgaaactgtatctacttgctgtgttgcaatattttgctgctggactttgacctacttgtattatgcagaaagttaatgcagatacctattcaagatgataactgtaaagacactgctgtctccttaatatgctccttaacacgtatgttgatgtagcatcattttgtggataggaaaaaaaatgtttgaccttcagatattttctacttaaaaaattgtggatgaacgccctatctccctcccacagtggagtccccattaccttgtctaaaacaattttttaatgtgttctgtggccgttttactgacagtaactgccatttcgtgtctgtggtaacaaagtgacttgtaaaatggtggatgtttccctcactgtgttctcttcgtgggttgtttccttgtgggtcatagtcataccttctgatgaggtggagccaacaccagcaaagtatgatggccctgtagcctctgactagtcctgaaacagaaggctgcactctaggctgaaccatgctaaaagcccatgcttaaataaaaaattatgtccaaaatcta

SEQ ID NO: 225 - DNA, 11453 bp, Rattus norvegicus
ttcgggagcctcggtctcccgccaacttccccccgcgggctcggttgcccggagccgctcggatcgagcccgccgccggctcgccttcccagcacgcggctcctccgtgccggtgcctccgaaagtggatgagagagcgcgcggggcgcgcggcggcacggagcgcggcggcatggagcgcggctgctgggcgccgcggactctcgtcctggccgtgctgctgctgctgctggcgacgctgagggcgcgcgccgccacgggctactacccgcgcttctcgcccttctttttcctgtgcacccaccacggggagctggaaggggatggggagcagggcgaggtgctcatttccctgcacattgcgggcaaccccacctactacgtaccgggacaggaataccatgttacaatttcaacaagcaccttcttcgatggcttgctggtgacgggactgtacacctcgacaagcatccagtcttctcagagcattggaggatccagtgcctttggatttgggatcatgtccgaccaccagtttggtaaccagtttatgtgcagcgtggtggcctctcatgtgagtcacctgcctacaacaaacctcagcttcgtctggatcgccccaccagctggcacgggctgtgtgaatttcatggctactgcaacacacaggggtcaggtgattttcaaagacgccttagcccagcagctctgtgaacaaggagctcccacagaggccactgcttactcgcacctcgctgaaatacacagtgacagtgtgattctacgagatgactttgactcctaccaccaactagaattgaaccccaatatatgggctgaatgcagtaactgtgacactggagaacagtgtggcaccatcatgcatggcaacgctgtcaccttctgtgagccatatggtcctcgagagttgactaccacatacctgaacacgacaacagcatccgtcctccagttctccattgggtcaggatcctgtcgatttagctactctgaccccagcatcattgtgtcatatgccaagaacaatactgccgattggattcagctcgagaagattagagccccttccaacgtgagcaccatcatccatatcctctaccttcctgaggacgccaaaggggagaacgtgcagttccagtggaaacaggacagcctgcgtgtgggtgaggtgtacgaagcctgctgggccctggataacatcctggtcatcaattcggcccacagacaagtcattctggaggacagcctcgacccagtagacacgggcaactggcttttcttccctggagcaacggtcaagcacagctgccagtcagatgggaacgccatatatttccacggaaatgaaggaagccagctcaattttgccaccacgcgggatgtagatctctccacagaggatattcaggagcagtggtcagaagaatttgagagccagcccacaggatgggacatcttgggagcagtagttggttcggaatgtggaaccattgagtcaggactctcactggtgttcctcaaagatggagagaggaagctatgcaccccctacatggatacaactggttatggcaacctgaggttctacttcgctatgggagggacctgtgaccctggagactctcatgaaaacgatgtcatcttatatgcaaagattgaaggaaaaaaagaacacatcgcactggacaccctttcctattcttcctataaggttccaactttggtttctgtggtcatcaatcctgaacttcagacacctgccaccaaattttgtctcagacaaaagaaccaccaagggcataaccagaatgtctgggctgtggacttcttccatgtgctgcccattctcccttccacaatgtctcacatgatccagttttccattaatctgggctgcggcacacaccagcctggtaacagcgtcagcttggagttttccactaaccatggccggtcctggtccctactccacaccgagtgtttgccggagatctgtgcaggtccccacctcccgcacagcaccatctactcctcggaaaactacagcgggtggaaccgagtcacgattcccctccctaatgcggcactcacccgagacaccaggattcgctggagacaaacaggacccatcctgggaaacatgtgggcaattgataatgtttatataggtccgtcatgcctcaaattctgttctggcagaggacaatgcactcgacatggttgcaagtgcgaccccggattttctggccccgcttgtgagatggcgtctcagaccttcccaatgtttatttcagaaagctttggcagttccagactttcctcctaccataacttttactctatccgtggtgctgaagtcagctttggctgtggtgtcttagccagtggtaaggctctggttttcaacaaagatgggcgacggcagctgatcacctcctttctggatagctcgcagtccaggtttctgcagttcaccctgaggctggggagcaagtctgttctgagcacgtgcagggcccctgaccagccaggggagggagttttgctgcattattcatatgacaatgggataacatggaaactcttggagcactattcatatctcaactaccacgagcccaggatcatctccgtagagctaccagatgacgcgaagcagtttggaatccagttcagatggtggcagccgtaccattcttcccagggagaagatgtgtgggccattgacgagatcctcatgacatcggtcctgttcaacagcatcagcctcgacttcaccaatcttgtggaagtcactcagtccctggggttctacctcggcaacatccagccatactgcggccatgactggacactttgttttacgggagattcgaaacttgcctcgagcatgcgctatgtggagacacagtccatgcagattggagcgtcctatatgattcagttcagcctggtgatggggtgtggccagaagtacactcctcacatggacaaccaggtgaagctggagtattccaccaaccacgggctcacgtggcaccttgtacaagacgagtgccttcccagtatgccaagttgccaggaatttacatcggccagcatttaccacgccagtgagttcacacagtggagaagagtgaccgtcatccttccccagaaaacatggtctggggccacccgcttccgttggagtcagagctattacacagcccaggatgagtgggctttagacgacatttacattgggcagcaatgccccaacatgtgcagtgggcatggctcatgtgaccacggcgtgtgcaggtgtgaccagggataccagggcactgaatgccacccggaagccgcacttccttccacgattatgtcagattttgagaacccgagcagttgggactcagactggcaagaagttattgggggagaagttgtaaaacctgagcaaggctgtggggtcgtgtcttccgggtcttctctgtacttcagcaaggccgggaagaggcagctggtgagctgggatctggacacgtcctgggtggacttcgtgcagttctacatccagataggcggagagagtgccgcgtgcaacaaacctgacagccgagaggagggcgtcctcctccaatacagcaacaatggcggcatccagtggcacctgctggcagagatgtacttctcagacttcggcaagcccagatttgtctacctggaactcccagctgctgcgaagaccccttgtaccaggttccgctggtggcagcctgtgttctcaggggaggactatgaccagtgggccgtcgatgacatcatcattctgtcagagaagcagaagcaggttatcccagttgtcaacccaactttgccccagaacttctatgagaagccagctttcgactaccctattaaccagatgagcgtgtggctgatgttggccaatgaagggatggctaagaacgatagcttctgtgccactacgccttcagccatggtgttcggaaagtcagacggagaccgattcgcagtgacgcgagatctgaccctgaaacccggatatgtgctccagttcaagctaaacatcgggtgtgccagccagttcagcagcactgctccggtcctcctgcagtattcacatgatgctggcatgtcctggtttctggtgaaggaggggtgctttcctgcctccgcgggcaagggatgtgaagggaactcccgggaactcagtgagcctactgtctattacactggagactttgaagaatggacaagagtcaccattgccatcccgaggtcccttgcgtccagcaagaccagattccgatggatccaagagagcagctctcagaagaatgtacccccatttggcttagatggggtatacatatctgagccttgtcccagctactgcagtggtcatggagactgcatctcaggggtgtgtttctgtgacctggggtacacagctgcacaaggaacgtgtgtgtccaacatccccaaccacagtgagatgttcgataggttcgaggggaagctaagcccactgtggtacaaaatatccggaggtcaggttgggacgggctgtggaaccctcagtgacggcaggtccctctacttcaatggccttgggaaaagggaagccaggacggtcccgctggacaccaggaatatcagacttgttcagttttatatacaaattggaagtaaaacgtcaggtattacgtgcatcaaaccacgggctagaaacgaggggcttgttgttcagtattcaaatgacaatgggatactctggcacttgctgcgggagttggacttcctgtcgttcctggagccacagatcatttctattgacctgcctcgggaagccaagacacctgccacggccttccggtggtggcagccgcaacacgggaagcactcagcccagtgggctttggatgatgttcttataggagtgaatgacagctctcaaactggatttcaagataaatttgatggctccatagacttgcaagccaattggtatcgaatccagggaggccaagttgacattgactgcctctctatggacaccgccctcatattcaccgaaaacataggcaaacctcgctatgccgagacctgggacttccatgtgtcagcctcaagcttcttacagtttgacatgagcatgggctgcagcaagcctttcagcgccacccacagtgtacagctccagtactccctgaacaacggcaaggactggcatcctgtcaccgaagagtgtgtccctcctaccattggctgcgtgcactacacagagagttcaacttacacgtcggaaaggttccagaactggaggcgggtcaccgtctaccttccactcgccaccaattctccgaggactcggttcagatggattcaggccaactacaccatgggagcagatgcctgggctattgataatgtcctactggcctcaggctgcccttggctgtgctcaggacgaggcatttgtgactcggggcgctgtgtgtgtgaccggggcttcggtggacccttctgtgttcctgtcgttcctctcccctccattctgaaagatgatttcaatgggaacttacatcctgacctttggcctgaagtgtacggggcagagagggggaatctgaatggcgaaaccatcaaatccggaacatctctgatctttaaaggggagggactaagaatgcttatttcaagagacctggattgcaccaataccatgtatgtccagttttctctccgatttatagcaaaaggtaccccggagaggtctcactccattctactgcaatcctccatcaatgggggggtcacctggcgcctgatggatgagttttacttccctcaaacaaccagcatacttttcattaatgtccccttgccgtacagcgcccaaaccaacgctacgagattcagactctggcagccgtacaacaacggtaagaaagaagaaatctggatcattgatgactttattattgatggggacaatctgaacaaccccgtgatgctgctggacacgttcgactttgggcccagggaagacaattggtttttctatccaggtggtaatatcggtctctactgcccgtattcttcaaagggggctcctgaggaggactcggccatggtgttcgtttcaaacgaaatcggcgagcactccataaccacacgcgacctaagtgtgaacgagaacaccatcattcaattcgagatcaacgtcggatgctccactgatagctcgtctgctgatccggtcagactggaattttcaagggactttggagccacctggcacctgctgctgccgctctgctaccacagcagcagcctcgtcagttcgctctgctccactgagcaccaccccagcagcacctactacgcggggaccacccagggctggaggagggaggtcgtgcacttcgggaagctgcacctttgcggatctgtgcgtttccgttggtaccagggattctatcccgccggctctcagccggtcacgtgggccattgataatgtctacattggtccccagtgcgaagagatgtgctgtgggcatgggagctgcgtcaatggaaccaagtgtatatgtgatcccggctactccggtccaacctgcaaaataagcaccaaaaatcctgattttctcaaagacgattttgaaggtcaactggaatccgatcgattcttactaatgagcggtgggaaaccttctcgaaaatgtgggatcctttccagtgggaacaacctcttcttcaatgaggatggcttgcgcatgctggtaacacgggacctggatctatcgcatgctaggtttgtgcagttcttcatgaggctgggatgcggtaaaggtgttccggaccccaggagccagcccgtgcttctccagtactccctcaatggcggcctctcctggagccttcttcaagagttcctcttcagcaactccagcaatgtgggcaggtacatcgccctggaaatgcccctgaaagcccgctctggttctacacgcctccgctggtggcagccgtccgaaaatgggcacttctatagcccctgggtgatcgaccagattcttattggaggaaatatctctggtaatacagtcttagaagatgatttctcgactctggacagcagaaagtggctgcttcacccaggaggcaccaagatgcccgtgtgtggctccacaggcgatgccctggtcttcattgaaaaggccagcacccgttacgtggtcaccacggacattgccgtgaatgaggactcattcctacagatagatttcgctgcgtcctgctcagtcacagactcctgctatgccattgaactggagtactccgtggatctcgggctgtcgtggcaccccctagtgagggactgcctgcctaccaacgtcgagtgcagtcgctatcacctgcagcggatcctggtgtcagatactttcaacaaatggaccagaatcaccctgcccctccctgcctacaccaggtctcaagccactcgtttccgctggcaccagccagcgccttttgacaagcagcagacgtgggcgatagataacgtctatattggggatggttgcctcgacatgtgcagtggccatgggaggtgcatccagggaagctgtgtctgtgatgagcagtggggaggcctgtactgtgatgaacctgagacctcccttcccacccagctcaaagacaacttcaatcgagctccctccaaccagaactggctgactgtgaatggtgggaaattgagtactgtgtgtggagccgtggcttcgggcctggctctccacttcagtgggggctgtagccgattgttagtcactgtggatctgaacctcactaatgctgagtttatccaattttacttcatgtatggatgcctcattacgccgagcaaccgtaaccagggagtcctgctggagtactccgtcaatggaggcatcacctggaccctgctgatggagattttctatgaccagtacagcaagcctgggttcgtgaatatccttctccctcctgatgctaaagagattggtactcgcttccgctggtggcagccacgacatgatggccttgaccagaatgactgggccattgacaatgtcctcatctcaggctctgctgaccagaggacggtcatgctggacacgttcagcagtgccccagtgccacagcatgagcgttcccctgcagatgctggccccgttgggagaattgcttttgatatgttcatggaggacaaaacctcagtgaatgagaattggctcttccatgatgactgtacagtagaaagattctgtgattccccagacggtgtcatgctctgtggcagccatgacggacgagaggtgtacgcagtgacgcacgacctgactcccactgagaactggatcatgcaattcaagatctctgttggatgcaaagtgcctgaaaaaattgcccaaaatcaaattcatgtgcagttttcaactgactttggcgtgagctggagttatctagtccctcagtgcttacccgccgacccaaagtgttctgggaccgtctctcaaccatctgtgttctttccaacgaaagggtggaaaaggatcacctacccgcttcctgaaagcttaatggggaatcctgtaagatttaggttctaccaaaagtactcagacgtgcagtgggcaattgacaacttctaccttggccctgggtgtttggacaactgtggaggccacggggactgcctaaaggaacagtgcatctgtgacccaggctactcggggccacactgctacttaactcacaccctgaagaccttcctgaaggaacgctttgacagtgaagagatcaagcctgacttatggatgtccttagaaggcgggagcacttgcacagagtgcgggatcctcgccgagaacactgcactctacttcgggggctccacggtgaggcaagctattactcaggacttagacctcagaggtgccaaattcctgcagtactggggacgcatcggcagtgagaacaacatgacgtcttgccatcggccggtctgccggaaggagggcgtgctgctggactactctaaggatggaggaatcacttggactttgcttcatgagatggatttccagaaatacatttcggtgaggcatgactacatcctcctccctgagggggccctcaccaacaccactcgacttcgctggtggcagccttttgtgatcagcaatgggctcgtggtttccggggtggagcgtgcgcagtgggccctggacaacattctgattggtggagcagaaatcaatccaagccaactggtggacacttttgatgacgaaggctcttcccatgaagaaaactggagtttttaccccaatgcagtaaggacagcagggttctgtggcaatccatccttccacctctactggccgaacaaaaaaaaggacaagacccacaatgctctctcctcccgcgagctcatcatacaaccaggatacatgatgcaattcaaaattgtggtgggttgtgaagccacttcctgtggtgaccttcattccgtcatgctggagtacactaaggacgcaagatctgactcctggcagctcgtgcagacccagtgcctaccttcctcttccaatagcatcggctgctcccccttccagttccacgaggccaccatttataacgctgtcaacagctcgagctggaagaggatcaccatccagctgccagaccacgtctcctcaagtgccacacagttccgctggatccagaaaggagaagaaacagagaagcaaagctgggccatcgaccacgtgtacattggagaggcttgtcccaggctctgcagcggacatggttactgcaccacaggggccgtctgcatctgtgatgaaagcttccaaggtgacgactgctctgtcttcagtcacgagcttcccagttacattaaagataattttgaatcggcaagagtcaccgaagccaactgggaaacaatccagggaggcgccatcggaagtggctgtgggcagctggcgccctatgcccacggagactcgctctacttcaatggctgtcagataaggcaagccgccaccaagccgctggacctcactcgagcaagcaaaattatgtttgtcttgcaaattgggagcacggcacagacagacagttgcaacagcgacctcagcggcccccacacggtggacaaggcagtgctgctgcaatacagcgtcaacaacggcatcacgtggcacgtcatcgctcagcaccagccgaaggacttcacacaagctcagcgggtgtcttacaacgttcccctggaagcacggatgaaaggagttttgctgcgctggtggcagccacgacacaacggaacaggtcatgatcagtgggctttggaccatgtggaggtcgtcctagtaagcactcgcaaacaaaattacatgatgaatttttcacgacaacatgggctcaggcacttctacaaccgaaggcgaaggtcgcttaggcgatacccatgaagaatccaagtttgtttccctttccagcatacaatgtgtcccttcccgtatttttgaaacacctctcactgcatccggtatcaggaaacaaagatgaaggacttggctaccagaaagcccttcaagaccaagtgtaccccacctccccacactgtgagctaacgatgtgcggcttctttgcgcataagtaaatgtcttcacgtcagtgcgtccgtggaaattgtgatctgttgtaatatcagttacagtggcagtattgagaataaatagtttaacaggaaaaaaaatttaagcacaaagggttttaaagattttatgttttaaatggcattttagcacagtatttaacgttcttggtcaccgagctacttaagtagactgtatttcagctttgtctcttgttttatatgattaagttatcattgtttgtcctttgtgtactctcctccacagtataacaccctgaaactgaatctacttgctgggttgcaatattttgctgctggactttgacctacttgtattatgcagaaagttaattcagatacctatcgagatggtaactgtaaagacactgttatctccttaaatatgcttacttatatgttactccttaacatgtacgttgatgtagcatcattttgtggataggaaaaaattgtttgaccttcagatattttctacttaaaaaaaaaaaaagttgtggatgaacaccctatctccctcccacaatgaagtccccattaccttgtctataacagttttttaaagtgttccgtggctggtttactaacagtaactgccatttcgtgtccgtggtaacaaagtgacttgtaagatggtggatgttttcctcactgtgttcttctcttcatgggttgtttccctgtgg

SEQ ID NO: 226 - DNA, 2550 bp, Mus musculus
cgccagcccgcgctccggctttgtgcaagattctcccggcacagaactgcccgcagcactcgagcaccaaagggtcatcgcgccctccgccagccggagccgtctggatgggcaccacggccgtgcgccggaggccacgagggacccagagcgagagcgggcggtgaaagaagccactaggccgaggcggtcggatgcgctctgcgagggagctccgagccgatcgcaaggactgccagcttccatccaccccccagggccctcgcctccagcctcagccgagcgctgagctcagatttggaaacaaacgccctagctctcccggcttcccacaactctatcttgcgaaagttggtgtgttccctgtcctgtggactcccacctccagctcttggcagaagactttaaccaagggcggtgagcagatgtgtgagatcttctattctagaagtggacgtatatcccagttctcagagccccgtattcgagccccgtgggatccggaggctgccaaccagctccagcatgcagaacagtcacagcggagtgaatcagcttggtggtgtctttgtcaacgggcggccactgccggactccacccggcagaagatcgtagagctagctcacagcggggcccggccgtgcgacatttcccgaattctgcagacccatgcagatgcaaaagtccaggtgctggacaatgaaaacgtatccaacggttgtgtgagtaaaattctgggcaggtattacgagactggctccatcagacccagggcaatcggagggagtaagccaagagtggcgactccagaagttgtaagcaaaatagcccagtataaacgggagtgcccttccatctttgcttgggaaatccgagacagattattatccgagggggtctgtaccaacgataacatacccagtgtgtcatcaataaacagagttcttcgcaacctggctagcgaaaagcaacagatgggcgcagacggcatgtatgataaactaaggatgttgaacgggcagaccggaagctggggcacacgccctggttggtatcccgggacttcagtaccagggcaacccacgcaagatggctgccagcaacaggaaggagggggagagaacaccaactccatcagttctaacggagaagactcggatgaagctcagatgcgacttcagctgaagcggaagctgcaaagaaatagaacatcttttacccaagagcagattgaggctctggagaaagagtttgagaggacccattatccagatgtgtttgcccgggaaagactagcagccaaaatagatctacctgaagcaagaatacaggtatggttttctaatcgaagggccaaatggagaagagaagagaaactgaggaaccagagaagacaggccagcaacactcctagtcacattcctatcagcagcagcttcagtaccagtgtctaccagccaatcccacagcccaccacacctgtctcctccttcacatcaggttccatgttgggccgaacagacaccgccctcaccaacacgtacagtgctttgccacccatgcccagcttcaccatggcaaacaacctgcctatgcaacccccagtccccagtcagacctcctcatactcgtgcatgctgcccaccagcccgtcagtgaatgggcggagttatgatacctacacccctccgcacatgcaaacacacatgaacagtcagcccatgggcacctcggggaccacttcaacaggactcatttcacctggagtgtcagttcccgtccaagttcccgggagtgaacctgacatgtctcagtactggcctcgattacagtaaagagagaaggagagagcatgtgatcgagagaggaaattgtgttcactctgccaatgactatgtggacacagcagttgggtattcaggaaagaaagagaaatggcggttagaagcacttcactttgtaactgtcctgaactggagcccgggaatggactagaaccaaggacctttgcgtacagaaggcacggtatcagttggaacaaatcttcattttggtatccaaacttttattcattttggtgtattatttgtaaatgggcattggtatgttataatgaagaaaagaacaacacaggctgttggatcgcggatctgtgttgctcatgtggttgtttaaaggaaaccatgatcgacaagatttgccatggatttaagagttttatcaagatatatcaaatacttctccccatctgttcatagtttatggactgatgttccaagtttgtatcattcctttgcatataattgaacctgggacaacacacactagatatatgtaaaaactatctgttggttttccaaaggttgttaacagatgaagtttatgtgcaaaaaagggtaagatatgaattcaaggagaagttgatagctaaaaggtagagtgtgtcttcgatataatacaatttgttttatgtcaaaatgtaagtatttgtcttccctagaaatcctcagaatgatttctataataaagttaatttcatttatatttga

SEQ ID NO: 227 - DNA, 6947 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 228 - DNA, 6883 bp, Homo sapiens
accctcttttcttatcattgacatttaaactctggggcaggtcctcgcgtagaacgcggctgtcagatctgccacttcccctgccgagcggcggtgagaagtgtgggaaccggcgctgccaggctcacctgcctccccgccctccgctcccaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 229 - DNA, 6891 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcagacccatgcagatgcaaaagtccaagtgctggacaatcaaaacgtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 230 - DNA, 2191 bp, Rattus norvegicus
gcgacgaaagagaggatgcctcttaaaggcagaagactttaactaggggcgggcgagcagatgtgtgagatcttctattcaaagagtggacatatagcccagttttcagagccacgtattcgagccccgtgggatccggaggctgccaaccagctccagcatgcagaacagtcacagcggagtgaatcagcttggtggtgtctttgtcaacgggcggccactgccggactccacccggcagaagatcgtagagctagctcacagcggggcccggccgtgcgacatttcccgaattctgcaggtgtccaacggatgtgtgagtaaaattctgggcaggtattacgagactggctccatcagacccagggcaatcggaggcagtaagccaagagtggcgactccagaagttgtaagcaaaatagcccagtataaacgggagtgcccgtccatctttgcttgggaaatccgagacagattactctccgagggggtctgtaccaacgacaatatacccagtgtgtcatcaataaacagagttcttcgcaacctggctagcgaaaagcaacagatgggcgcagacggcatgtatgataaactaaggatgctgaacggacagaccggaagctggggcacccgccctggttggtatcccgggacgtcagtaccagggcaacccacgcaagacggctgccagcaacaggaaggacagggagaaaacaccaactccatcagctccaatggagaagactcggatgaggctcaaatgcggctgcagctgaagcggaagctgcagagaaatagaacatcttttacccaggagcagattgaggctctggagaaagagtttgagaggacccattatccagatgtgtttgcccgggaaagactagcagccaaaatagatctacctgaagcaaggatacaggtgtggttttctaaccgaagggccaagtggagaagagaagaaaaactgaggaaccagagaagacaggccagcaacaccccgagtcacatccctatcagcagcagtttcagtaccagtgtctaccagccaattccacagcccaccacacctgtctcctcctttacatcgggttccatgttgggccgcacagacaccgccctcaccaacacgtacagtgctttgccgccgatgcccagcttcaccatggcaaataacctgcctatgcaacccccagtccccagtcagacctcctcgtactcctgcatgctgcccaccagcccttcagtgaatgggcggagttatgatacctacacccctccgcacatgcaaacacacatgaacagtcagcccatgggcacctcgggaaccacttcaacaggactcatttcacctggagtgtcagttcccgtccaagatcccggaagtgaacctgacatgtctcagtactggcctcgattacagtaaagagagagaaagagagagaatgtgatcgagagggggattgtgttcactcagccaatgactatgtggacacagcggttgggtattcaggaaagaaagagaaatggctgttagaagcacttcactttacaactgtgtcctatactggagcccgggaatggactagaaaccaggacctttgcgtacagaaggcacggtatcagttggaacaaatcttcattttggtatccaaacttttattcattttggtgtattatttgtaaatgggcatttgtatgttataatgaagaaaagaacaacacaggctgttggatcttggatctgtgttggctcatgtggttgtttaaaggaaaccatgatcgacaagatttgccatggatttaagagttttatcaagatatatcgaatacttctacccatctgttcatagtttatggactgatgttccaagtttgtatcattcctttgcatataattaaacatggaacaacatacactagatatatgtaaaaaatatctgttggtttttccaaaggttgttaacagataaagtttatgtgcaaaaaagggtaagatatgaattcgaggagaagttgatagctaaaaggtagagtgtgtcttcgatataatccaatttgttttatgtcaaaatgtaagtatttgtcttccctagaaatcctcagaatgatttctataataaagttaatttcatttatatttgaaaaaaaaaaaaaaaaaaaaaaaaaaaaaaaaaaaaaaaaaaaa

SEQ ID NO: 231 - DNA, 20 bp, Artificial Sequence
  Description of Artificial Sequence: Synthetic primer
gcatgcactacatacatatt

SEQ ID NO: 232 - DNA, 20 bp, Artificial Sequence
  Description of Artificial Sequence: Synthetic primer
ttactgagcactgagccttc

SEQ ID NO: 233 - DNA, 20 bp, Artificial Sequence
  Description of Artificial Sequence: Synthetic primer
ctattaatccgtccccagca

SEQ ID NO: 234 - DNA, 20 bp, Artificial Sequence
  Description of Artificial Sequence: Synthetic primer
tggagttggcgagctcagca

SEQ ID NO: 235 - DNA, 20 bp, Artificial Sequence
  Description of Artificial Sequence: Synthetic primer
ctcttaggtgcaaagggaga

SEQ ID NO: 236 - DNA, 20 bp, Artificial Sequence
  Description of Artificial Sequence: Synthetic primer
gctgctgctgctgctgcggc

SEQ ID NO: 237 - DNA, 20 bp, Artificial Sequence
  Description of Artificial Sequence: Synthetic primer
caggcagctgttcagacata

SEQ ID NO: 238 - DNA, 20 bp, Artificial Sequence
  Description of Artificial Sequence: Synthetic primer
gctggagctggttggcagcc

SEQ ID NO: 239 - DNA, 19 bp, Artificial Sequence
  Description of Artificial Sequence: Synthetic primer
agtagtggcagtaccggat

SEQ ID NO: 240 - DNA, 19 bp, Artificial Sequence
  Description of Artificial Sequence: Synthetic primer
ctcgtgcaagttgcttagg

The invention claimed is:

1. An in vitro method for assessing embryotoxicity of a chemical during myocardial cell differentiation comprising:
   (A) culturing in vitro a first transformed mammalian embryonic stem cell in a medium for myocardial differentiation containing a test chemical, wherein said first transformed mammalian embryonic stem cell is a mammalian embryonic stem cell transformed with a reporter construct which comprises a Hand1—or orthologous gene promoter sequence operatively linked to a heterologous reporter protein coding sequence, to obtain a first cultured cell;
   (B) culturing in vitro a second transformed mammalian embryonic stem cell in a medium for myocardial differentiation not containing the test chemical, wherein said second transformed mammalian embryonic stem cell is a mammalian embryonic stem cell transformed with a reporter construct which comprises a Hand1—or orthologous gene promoter sequence operatively linked to a heterologous reporter protein coding sequence, to obtain a second cultured cell;
   (C) measuring the expression level of the reporter protein in the first cultured cell to obtain a measured value;
   (D) measuring the expression level of the reporter protein in the second cultured cell to obtain a control value; and
   (E) comparing the measured value with the control value obtained from the cultured cells on the day when the expression level of the reporter protein in the second cultured cell is the highest during myocardial cell differentiation, wherein when the measured value is lower than the control value, the test chemical is assessed to have embryotoxicity during myocardial cell differentiation.

2. The method according to claim 1, wherein the medium used in the culturing of (A) contains the test chemical at a concentration not showing inhibition of cell proliferation.

3. The method according to claim 1, wherein the measured value and the control value are obtained from the cultured cells on day 6 of the culturing.

4. The method according to claim 1, wherein the reporter protein coding sequence is a luciferase coding sequence or a fluorescent protein coding sequence, and the promoter sequence is 5, 2 or 1 kb of the promoter region of the Hand1—or orthologous gene.

5. The method according to claim 1, wherein the mammalian embryonic stem cell is from a mouse.

6. The method according to claim 1, wherein the mammalian embryonic stem cell is seeded in a nonadherent U-bottom 96-well plate.

7. The method according to claim 6, wherein the mammalian embryonic stem cell is seeded in a cell suspension of 15,000 cells/mL.

8. An in vitro method for assessing embryotoxicity of a chemical during myocardial cell differentiation comprising:
   (A) culturing in vitro a first transformed mammalian embryonic stem cell in a medium for myocardial differentiation containing a test chemical, wherein said first transformed mammalian embryonic stem cell is a mammalian embryonic stem cell transformed with a reporter construct which comprises a Cmya1—or orthologous gene promoter sequence operatively linked to a heterologous reporter protein coding sequence, to obtain a first cultured cell;
   (B) culturing in vitro a second transformed mammalian embryonic stem cell in a medium for myocardial differentiation not containing the test chemical, wherein said second transformed mammalian embryonic stem cell is a mammalian embryonic stem cell transformed with a reporter construct which comprises a Cmya1— or orthologous gene promoter sequence operatively linked to a heterologous reporter protein coding sequence, to obtain a second cultured cell;
- (C) measuring the expression level of the reporter protein in the first cultured cell to obtain a measured value;
- (D) measuring the expression level of the reporter protein in the second cultured cell to obtain a control value; and
- (E) comparing the measured value with the control value obtained from the cultured cells on the day when the expression level of the reporter protein in the second cultured cell is the highest during myocardial cell differentiation, wherein when the measured value is lower than the control value, the test chemical is assessed to have embryotoxicity during myocardial cell differentiation.

9. The method according to claim 8, wherein the medium used in the culturing of (A) contains the test chemical at a concentration not showing inhibition of cell proliferation.

10. The method according to claim 8, wherein the measured value and the control value are obtained from the cultured cells on day 8 of the culturing.

11. The method according to claim 8, wherein the reporter protein coding sequence is a luciferase coding sequence or a fluorescent protein coding sequence, and the promoter sequence is 5, 2 or 1 kb of the promoter region of the Cmya1—or orthologous gene.

12. The method according to claim 8, wherein the mammalian embryonic stem cell is from a mouse.

13. An in vitro method for assessing embryotoxicity of a chemical during neural cell differentiation comprising:
- (A) culturing in vitro a first transformed mammalian embryonic stem cell in a medium for neural differentiation containing a test chemical, wherein said first transformed mammalian embryonic stem cell is a mammalian embryonic stem cell transformed with a reporter construct which comprises a Reln—or orthologous gene promoter sequence operatively linked to a heterologous reporter protein coding sequence, to obtain a first cultured cell;
- (B) culturing in vitro a second transformed mammalian embryonic stem cell in a medium for neural differentiation not containing the test chemical, wherein said second transformed mammalian embryonic stem cell is a mammalian embryonic stem cell transformed with a reporter construct which comprises a Reln- or orthologous gene promoter sequence operatively linked to a heterologous reporter protein coding sequence, to obtain a second cultured cell;
- (C) measuring the expression level of the reporter protein in the first cultured cell to obtain a measured value;
- (D) measuring the expression level of the reporter protein in the second cultured cell to obtain a control value; and
- (E) comparing the measured value with the control value obtained from the cultured cells on the day when the expression level of the reporter protein in the second cultured cell is the highest during neural cell differentiation, wherein when the measured value is lower than the control value, the test chemical is assessed to have embryotoxicity during neural cell differentiation.

14. The method according to claim 13, wherein the medium used in the culturing of (A) contains the test chemical at a concentration not showing inhibition of cell proliferation.

15. The method according to claim 13, wherein the measured value and the control value are obtained from the cultured cells on day 9 of the culturing.

16. The method according to claim 13, wherein the reporter protein coding sequence is a luciferase coding sequence or a fluorescent protein coding sequence, and the promoter sequence is 5, 2 or 1 kb of the promoter region of the Reln- or orthologous gene.

17. The method according to claim 13, wherein the mammalian embryonic stem cell is from a mouse.

\* \* \* \* \*